United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 50

SEQ ID NO: 777 - DNA, 440633 bp, Homo sapiens
cccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccccaggaacgtctgtttttagtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgctctatgaaaagtgacttttattataattgtcaaagacagaaatttgtctgtcttgtccttttgttttgtctgaagccccgcgttatcgctgcagagagagagttttggtttccaccgaaatttccctgcctccgattgtttaaaccagacccttaatcttattttaacatatttaaaatgttcacaaaacccggaagaattgttttgtgtaagtagcaagcgagtgtagcttaaacactcaagcaattctggtatctaattggaaacaggtggaattcttggaatcccatgtttgagtctttttatagcaaagcccagggacacttttcacttatagccattcgttttgtcgaagctatttgaagaggggccccacagcctctccttatgtcccactgttgcttacctggacaaagcagtcgtgctgggcgctttaggaactggatacctgtgaatgcctggatgccgagagaagtgtgtgtgtgtgccgataatggagtgaaaaaggaatctaatggtatagttagacaagcaatttaatatctgcattgttatatgactttagagcaaagaatttgtgaattcatttgtgatttctgacttgatgaaccttgactgaccagagcatgtaggtacattttattataccccaataatgatatagaattcagagagaagatactcccccccgcccccaaaaaaattctacatttagagaatataagctccaccagcaaccataaaagtattaacttggtgagggggatattttctttctttttttttttttttgagacagagtctcgctctttcgcccaggccggagtgcagaggcactatctcagctcactgcaaactccgcctcccgggttcacaccattctcctgcctcagcctcccgagtagctgggactacaggcgctggccaccaggcctggctaattttttgtatttttagtagagacggggtttcaccgtgttagcccggatggtctcgatctcctcacttagtgatccgcccgccttggcctcccgaagtgctgggattacaggcgtgagccaccgtgcccggcccctattttcttttcttttctttttttcttttttcttttttttttttttttttttttttttgagacgtggttctgtcgcccaggctggagtgcagtggtgcgatctcggctcactgcaagctccgcctccagggttcaggccattctccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattgcttgagcccaggaggtggaggttgcagtgagctgagatcgtgtgactgctctgcatgcagcctgggtgacagagcgagactctgtctcagaaaaaaaaaaaaaaaagacatctaatttgttgtaaaacctgtcaagaaccttccctttaaaaagctaatgcctctctaataaaaataattttaattttgttgtaattaaattcagagaggatgatgttagtgcacaaaataaagattgtcaatttctttattttaatccaacggcatttcctaactgcaggaggcccaggaccgttggcagaaattttgtgttgattagagcctcgggccatgggaagtgcaggtactgtggccacaaagttcgtcgcccaatccctggctgaccccacaagcaggactggtacagatcccaccctcaggggtcttcctacacagagaaacataatcacacaggtgactggaacggagccaaggatggtggtgttcctcctagggatttactaacactgccagcaactcaagaactagccagccgggagtttcctagtaagtgaaactgacttggttctgcttcctttcatgaaaacctttgtgaaaatgagcccaataaggggtccgaacctttataaagcacacgaccccccagagtggaccgggccctggccgactccatcagccgaagcttgagatcttggatggtctggatggtcttgaccgtgtgtgattgatgcagttaacaaagcaggaaattaacagagcttactctgagacaccagggaagtggcttgttctttcttggggttactttgagtggatgctggcacactgcttgttttcttatagatacctttctattgggctgtgtttattcaataaggaaatgcagttaacatttttttaacaagtaaaccatgggttatgaggtgttccgagtttggttaagggaaaaacaaattgacaaattagctctttcttaagtgagtattgcgaaacagtgagaaatagaatgcctgtcgtaccgtcattaaaaatttatctgggtgttgacagctttttgttaaatgtaagacattcagatcctgtccacccagcatatgaaaaaaccaaaccaaaccaaaccgaaaaacaaaatgcaacacaaaagcttctttccatttccccccaaaagcaagacaatttttcttaaactggggctttctccctaatgaattgccatgattttgttttctctaacatagtttaatatctttaagacagaacgaatatcaactctttttattttattttttgagacggagtctcactctgtcgcccagcctggagtgcagtggcacaaactccgctcaccgcaacctccacctcccaggttcaagtgattctcgtgcctcagcccccccgagtagctgtgattacaggtgtgcaccaccacgcccagctaatttttgtgtttttagtagagacagggtttcaccatgttggccaggctggtttcaaactcctgacctcaagcaatccacccccttcggcctcccaaagtggtgggattacaggtgtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatggagacttaaaatagcagtggcttcccgcctagagggcggacaggactggcaggacgaggctgggatggatggagcagtgtgtctgagcctctgggaaggctgcaggaagggcttggaaggcgggtcggggagtgggcagggggcgcccactgagttctgtgtgcttggggaggtgtgggagacagggctttccagcagaacagtcgtggggtggccggggatctctagggctcccctctgagcttgggttccctccctctgccctgattatcccttgggtacccaccacaccatcgccacacaggcccccactctctgccttgtgtgtccgatttaggactcattcagctggttaagaatgcaaaattaattcttttttttaatatagtgaaagcaggtagattatattaaaatggctgtgttttgaaagctactgataggtacacctatggaatagatgtttctttttcagtcccattaattatctttctgtgcaaagtaacataagtgttactttttcagtcccattaattatctttctttgcaaagtaacataagtgttggttaaaatacagttgacccttgaacaacatggggattaggggctgatcccttctgctgttccccctaccccacctgcacagtcaaaaatccacgtataactttttttctcccctcccctccttctcttctcttctcttctcttctcttctcttctcttctcttctcttcttttcttttcttttcctttcccttccttttcagacggggtctcattctgtcacccaggttagagtgcagtgacataatcatagctgactgcagcctggacatccggggctcaagcagtcctcccacatcagcctcccagtagctggaactacagacactcaccagcatgcctggctaatttttaatttttttctttttttagagacagggtcttgctttgttgcccaggctggtcttgagctcctgggttcaagtaatcttcctgtcccagcctcctaaagagctgagattataggcatgagccaccaggcccacataaaacttttcattccccaaaaacttaattactaatagcctaccgctgatgggaagccttaccgataacataaacagttgcttaacatgtattttgtatgttaatatgtgtgatatactgtattcttagaatgaagtaagctaaagaaaatgttattaagaaagttgtaaggaagagagaatatatttactaatcagaatatagaatggatcatcataaaggtcctcattctctttgccttcatgttgaggagtctgaggaggaagaggaggcgttggtcttgttgtttcaaggtggtggagatggaagggctggagcaggtggagggggagtcgggagaagcaggcccaattggtataacttgttttttttttttttttttttgagatgggagttttaccctgtcacccaggctggagtgcggtggcggatctcgactcactgcaaccttcgcctcccaggttcaagtgattctcctgcctcagcctcctgagtagctgggactacaggcacccactactacacccagctaatttttatagtagagatgggtttcaccgtgttggccaggttggtctcagaattcctgacctcagatgatctgtccgcttcggcctcccaaagtgctgggatgacgggtgggagccaccatacccagccccactcaatgtcacttttattatggaaaaaaaaaaatctgcgtgtaagtggccccacacagttcaaacctgtgttgttcaagagtcagctatatgtataattgtacctgtggcacatagaacacaaaaagatccacatttttaaaaacagcattgggcagaacaattttttgacagaggtctgtttgactctgctgacagcctgagtgggaggaaacttccccatatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcctcttcatttagtctaagaaactacctaggatatttttgtagaggtgacatcactgtctggctgcagaagcatttgcttggatttggggaagtgagggctgggagaggagggcttagagaggcaggatgcccaggcccattgcgggtggctgatggggggtgggcttagcatctgcagggacagggtggagggagaggagccaccccaggcagggggaaggggtgtgccccctttgggatatggaggttttggggggctggtgggagggaattccaggggtcgagcccctggggaaaaggaggctttaaggtcagtggaaaagtgggtgccaaagtctggaagatgagttgaaacctggagtttgaagcccggggaggattttgttggagtgttggctggtgctggagagttttgcatcacttggggtggggtggggtgaagaattaacttgaactggcacagcacccctttgtcttgactttccctgttctggagtgaggacggcttgatgtttcagcaaaaggagtagtggagagggagaatatttgcttgtaggattgggttccacataccatatctacagttttacatccactggtgacaagacaggagcttttctatttttgttttgtatttttatgtttttgtgcactaacagtaatggtttcatgggaacagatggcggacggacacgggcttaggctcttggtttatttcatgttacttgcatgacagccctatggagctgcgtacctgccataggtgagaagccgggagttggggttacatcccggactttgctgagctccaggagtgtttttcctcccgacctgcgctgttccctagacaaccctcagccgaagcagtggggtcatcgggtgactcagaagggacctcttctcaggggccgcccaagatgagcttggctgggtctgggtcacttagcagtgagcagcaggggatggaaatggggccggggtgggtgggcttgaggggagcactttctcagggacgcctggctggagccttgccctggcaagacttcaaactcagccccgcagagaagggtcatctgatgatagaatcacggctgccccatcattcccattagcaaacttcatctgatagttggggtacggttgtggctcaggctgtaaggagcccccctgttgcattactcactatcctcagatgccccatccttgcctgaagcaagtttgttgggacagttttggggaactgttaggagagaggcctggtcatggggccggaggggcccagaggagcggcctgccctatctgtgggcggttcggtgagtgctagatggggtgtctctttacaagactttcctctgagatgctggggctatgcccctgggtgctggggagtgaattgcccgtagatactgatacctgtacttaaccctgtgacggtcaagaccagatccccactctccaagcccctgggaaactggttgatgtagcccctgcagtgataccgcactcaaatccatgcagatcccctgacatggtcggggcagcacccaccacgcaggcttctgttctgagctacatgggatgttgggcgtgtgttttctaagagactgatttcataagacatgtaccagtggccgactggcctgaaacagcctggtcacagcgacatccctgagatcttagcttcttttcctcggggaattatcattggactggaaaactgaggttttgggccactctggattcagatgcttttgttgttgttgttttgagacagggtcttgatctgttgtggactgcagtggtgggatcatagctctctgcaaccgcgaactcccaggctcaagtgatcctcctgcctcagcctcctttgtagctgggaccacaggtgtgccccaccatgcctggctaattttttttacatatttttatacaaacagggtcttagtatgttggccaggctggtctcaaactcctaggctcaagtgatcctcctgcctcagcctcccaaagtgccgggattatataagcgtgagccaccacgcctggcccagataactcttgcctgcctgatttttttataatgatgcactttgttttgttaaaaatttataaatttaaagacaaaatatgcaaaaatgtgccctggtctcagaaataacacagcacattcgagtgaagttgttggcagttccgtgtgttttggggtgattcatttttttcataggttgttggggccgtgcatccattcgtgttctgagcacactccatggtacctgatgactcgaatggatcctgttcaagcccctgggttacccaaagaaatatacttctggcctgctggttggtcagagaatgcaggacacattggggtatcgcgaggtgtccaatggcagcgggttgggtgtgtctgctgtgtgaacagggcaggggtttgggaagatggactctggctgtcttgctccaaagacttccttaggctgttgttgagcatttattgagtgtctcctgtgtgccgggcagcattctagcatagggattgagtgaccagacagtagggaatccttgcccttaaggaactgacattcttttttttttttcgagatggagtcttgctttgtcgtccaggctaaagtgcagtggtgcaatctcggctcactgcaacctctgcttcctgggttcaagtgattctcctgtctcagcctcctgaatggttgggattacaggtgtgcaccaccacgccgggctaattttctgtatttttagtagaggcggggttttgccatgttggcctggctggtctcgaactcctgacctcaggtgatccacccacgtcagcctcccaaagtgctgggattacagccgtgagccaccatgcctggccggaactgacattcttgcaagggggatggaagacaaaggcaaggaataagtgagtgcccagtggcctgggaacagacggagcaggactgatacacaaagccccacagagtcacttctgtcttctgaaggccctgagaaataactttattattattattattattatttagagacagagtctcgctctgtcgcccaggctccagtacagtggtgtgattatagctcactgcagctttgacctcccgggctcaagctatcctcccacctcaggttcccgagtagctggaattacaggcatgcgccaccatgccaggctaacttttttgtattttttgtagagatgggggggtctcactgtgttgcccaggctggtcttgaactcctggcctcaggcgatcctcctgccttagcctccgaaagtgctgggattccaggcctgagctgccatgcctagccccgatttttaaactgaagagggatggttcagttgttggggtgtgtcttagaggatccttctggaagccccacatggaaggcgggctagagtgaggagggaggggtgataatggaaccaggagggtgtggtggtcatggcccagtgagaggatgccaggctgtggccgtgccagactcagtgtgcctggccctggcatttcaggcagggaccactgaggggtgatgggagagatggggctgggtgagtggcatttccacaggcatccagaggggtgcgaaaaactgaggttggggaacagcaggggcagggaacagcctgtggagggtgtggtcatcagtgtcccccaccgacatggcacatccagcgagcccactgtgtccccagcacctgcggtgcagggggctggcaccttcaggggcgggcttcgtgcagacgtccacccagtcagtccccacaggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcctgggtgacagagcaagaggaagactctgtctcttaaaaaaaaaaaaaaaaaaaaaaaagaatccaaaagcaagcttatggagaagggagaaagtgcgacagtcacctcggggcgtgggagagcagaagatggatgtcaggttaaaaaccattactgtgctgtagtatttccaggaggccaagtccagggctctgggacctgtacactgcggcatcagaccctaaaacagagctctcaggttttcgccttcccaggaagtctgcatcctttttgcagactggttttattctgtgttaggaggaggcgattttgctaagaaatcttcactgcaattttcccccccaaatcagggcacttggcatctccttctaacggggggtgcagagtctgtcctagaatgggacgcacagtgttcacacgagtaccgagtaggtggggtgctgggccggcccctctgatcctgtcctaccctgtgcagccacgtgcctttccttatccccagacttctgttgtcacgattcttccagggaagaatctggaagtggaatccacagggcggtgcccagggatggcctttagtgcctagtgttctgtttcagagagaggcctcttatttatttgaaaagctgattgtttcttttttttttttttttttttttttttgagatggagtctccctctgttgcccaggctggagtgcagtggcactatctcagcccactgcaacctccgcctcctgggttcaagcgattctcccgcctcagcctcccgagtagctgggactacagacacccgccaccacgcccagctaatttttgtatttttagtagagatggggtttcgccatgttgcccaggctggtctggaactcctgacctcaggtgatctacctgccttggcctcccaaatgctgggattacaggcatgagccaccacgcccagccttattttctatttttaaagaaagagcaagactgaaaacatttgcatgcacagtgagttttaaaaagttcctttttttagagaggaccaagaaggtgcagagtactcttgaaaagaaattttttttctgttctaaacgtgccgcttgttgccctggtgcagagagcagttcttttgatacaatacctccgtcccgtaacttttttttaaagctaaaattcatataatgtaacatttacctttccaaagtttaaaattctggccaggcctgtaatcccagcactttgggatgctgaagcgggcagaccacttgaagccagaagtttgagatcagcctggccaacatggcaaaaccctgtccctactaaaaatacaaaaattagccaggtgtggtgagcgcttgtaatcccagctactcaggaggctgaggcaggagaatctcttgaacccgggaggcagaggttgcggtgagccaagatctcgccactgcactccagcctgggtgacagagcgagactctgtgtcataaataaataaataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtccaattatacacttttagttattttatttgtttgtttattttgagttggagtttcactgttgttgcccaggctggagtgcaatggcgcgatcttggctcactgcaatctccatctcccgggttcaagcgattctcctgcctcagcctcctgagtagctgggactacagctgccatgcctggctaatttttgtatttttagtagagacgaggtttcaccatgttggccaagctggtctcgaattcctgacctcaggtgacccacccacctggcctcccaaagtgctgggattacaggcgcgagccaccgcgcccagttgcttttagttactttaaaatgtacgattaaattatgatcgactatagtcaccctgttgtgctgtcaaatactaggccttattcattgattctatttttttgtagccattagccgtcgctacctccctgcattgttgcattttggcctcttatgtgtaagtcccgtttgttctccagaatgctgcttttaacacccagcccgttccatctctctctcttctgccttgggtgtcatgctgtctcttcctcagatttctcctggggtgcaggtgctcccctgcgaaccactgctgtgcacaaagtgattttgtgctcaggcaggtggatcgcttgagcccaggagtttgaaaccaccctgggcaatacagtgagaccccatctctacaaaaaaaatggctgttgtgcagtttgggatgagagttggttgcccccgcggtcctcccttcccccaaccccacctgccctccttgctcagcaacaagggacccccttcactggactatgaagcctgagggttgtctaaatcaatccttggccaggcgcagtggctcatgcctgtaatcccaacactttgggaggccaaggcgggtgcatcacctgaggtcaggagttcgagaccagcctggccaaggctctgagagcagcgagactccttctcaaaaaaaaaaaaaaaaaaaaaagaatcctggctgttccttccccacggccagtgggcattacactttgttttggctggagaaaccgggagtgcccgttgtctgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatagtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtcaaaaaaaaaaaaaaaaaaaaaaaaaaaaaaggataccaaaattctcaagtcaaattataagggttttaacattcccatttctacaccacgtgcaagaaaaacaaaatccttgttttctgcctgcctttatggtccgttctcattttcagccccctttcctcattctactctattaattatgcctttatatggatgcaaacttgtaaaatatgtggcctattttgtgtgtatacgtggttttaattcataagtgtggcactgtgccctaaatctttttctccttccttttcactcgtcacatttttttttttttttaaatgacacagagtctcgctctgtcgcccaggctggagtgcagtggcacaatctcggctcactgcaacctacgcctcctggatttaagtgattctcttgccccagcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcaccctcggtggtatctgacccccctcccccaagcccctccatgcacagcactgctaggaacgttcttacacacgtcccttaccagtatccaggaaaagccttgctggatccagccagatagtggtccttctttcacgaagcacctccagatcgcttcccagcgtggctgccccacttactcccccacccacagtcgtgagagtttctttcccccacaatctcatccgtgctttgtggagatattttttgccagtgagatggttttaaagtggtacttcagtgttgtgtcattttctctgatcaccagggaagtcgatctttgcgataagcctcattttatacttgtcagcttttcagatttcgccttttgtaaattgtctggtcatatattttgtcctctttttttttttctaaatggtttaccatctttttgttgatttgcaagagctccttgtatgtttcacatgcgaataatttgtcaattttctttcttttttttgttttttgagacagagtttgctcttgttgcccaggctggagtacaatggcgcggtcttggctcacttcagcctctgccacctgggttcaagcgattctcctggctcagcctccccagtagctgggattacaggcatgcgccaccacacctggctaatttttgtatttttagtacagatggggtttcaccatgttggtcaggctgatctcaaactcctgacctcaggtgatccgtctgcctcggcctctcaaagtgctgggattagaggcgtaagccaccacgctggccgttatagttttttaaattaaaaaaatttaaaattctaatagattattgtggtatagaggaaacaattggtttttgttgatttcgaagctgggaagcttgctgttaatatttttactaattaacttgattctgttgcattttctctggaaataatatatgcaaaataatgcaagtttttatttgttcctttccttctgattcttacagtggagtgacttgctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctcccatttctacattctgtatttctgaatttatttacaactcttctctttatttttagttgtacatagaggtttgtttatcttactgatcttgaaaaaacagcttttggtcttgttaatcttgccttttttttatgtggcttatttctcaccattattttactttctgagtgcattttttttctaacttatttttttgaatactcagctttttatttcattttatttatttatttatttatttatttttgagacagcctcactctgtcacccaggctggaaggcagtggtgtgatcttggctcactgcagcctctgcctcccgggttcaagtgatcctcccacctcagtctcctgagtagctgggagtataggcgtccctgccaccacgcccagctgagttttgtatttttagtagagacagggtttcaccttgttggacaggctggtcttgaactcctgaccttgcatgagccacccacctcagcctcccaaagtgctgggattacaggcatgagccaccactcctggccttgaatactcagctttttaaattggggttctttcttgttttggataaatctattcaaaactgtaacatttctgctaagtattattttagctgtgttccacaaattttgacatgtagtgctttcatttttattcattttgtaattttctattcattttgtaatttcccttataattttctctttaacctaagggttatttaatactgtatattttttagatttttgacacttttctttaatggcttttaaaaatgttgttgctgtcatttttatcacatatggtcagagaacatagttcacataatcctggttctttggaatctatgaggtcttctttttggtgtcttgcacatggtggatttttgtgaattttccatatgtgctcaaaaagaatgtgttttttgagtagaaaaaaacgttatatatgcagtatacaagtgacatataccatatagtcatacagtttgtttggtatatggaatacattcatgtcactgtttctttgataattttcttcccatagttttttttcttctttctttctttgagacagagtctcgctgcatcacccaggctggcacgcagtggcgtgatctctgctcactgcaacctctgcctcccaggatcaagcaattcttgtgcctcagcctcccaagaagcgagaattacaggagcacatcaccatgcccagctaattttcctagttttagtagactgggtttcattatgttgctcaggctggtctttaactcccggactcaagtgatcctcttgcctcagcctcccaaagtgttgggattacaggtgtgagccaccatgctgggccttcctacagtttttgacagttgttacattatattaggttaaggctgtactgttacattgcatgtatgatcatgatcatgatctttagattttcctgatgtattggttttttttttttgatgtctgtatagactcttattatgtttttcatgttaaattctattcgttttgacattaaaattattctattttttttttttttttttgagacagagtctctctctgtcgcccaggctggagtgcagtggcgcgatctcggctcactccacctcccgggttcacaccattctcctgcctcagcctcctgagtagctgggactacaggcgcccaccaccacacccagctaattttttgtattttttagtacagacggagtttcaccgtgttagccaggatggtctcgatctcctgacctcatgatccgcccatctcagcctcccaaagtgctgggattacaggcgtgagccaccgtgcctggcctattctcctattttttttgtttgtttttggtttccatttgtttgatgttgctttttctctttaattatttccaatccatatcattttgctttcattgcatttgttgcagatctgtgatgtaagatcttgtttttaaaacccaggttgagaatctttgataagtgaatttagctgagacacatttctggtagttgtgttatattaggatttctgccatcttattttgtgttttctgcttaccattacttatttttaaaaaagcttttcttgtaatgctttgtagggttgaactttcttctgctggattttaaagttgtgcaatctattttattcttctagagctcagaattgtgattattcttaaaattattaagagccacttatgtgattagtttttcctatccatttcttttttttttcttttagaatataattgatttttaaattcacttacttgtttcaactgcctggagtagggattcctgtcagtttctaaaggctattaatatctttgtctttctgtcaaacaagttaagtgatagggacctcgtttcctcccttcagcctgttgagatcgtttagattctaggataatggtgccatataggactgtggccctcgggtgtgcagaatcagcgtcaccaggtattagactttcagtattaatgttctctccttgctagaatatgtgaacaaatgtgaaccttttgaaagagccaatccttcaggatggatccagaatggctaaccaggcctaaatctaaaatagagccagacggccatttgcagattggaagtcacacacttagtctgagttccctgaaaacctgcacctttcttaagtttgggactttcagagctcacctgacccaactagtctgagttcaccagccctggccaatcagggctcagctgtgtcaaccaatcagccctaagcacgtttgaatcattcataaagaaatctgactgggaacctgggtgggcactgttgctattaacaaacaccgtccccctccccgcccccgcccccgcccccaaccccagcagcttctgtttacacggaaggctgcatctccctggtttgcacgttgtccacgggaataaagtctctttcctccagattccttttcagagcacttttgttaagtattttaaatgatagtgcatttaaagaagtctttctgtgataaacttcctgagactttaaagtctgagtctatacttattccaccctcatatttaagtgatacattagctggatgtaaaattgtaggtcaaaattctttttcttcaacacccagattattcccctgttttctttttgcacagagagtcacggttgagaaatatgaggacagtgtgattcttactgctttggagggaagtctggtttttctttttatccctgtcttcattcttttttctttttatccttgtcatcgttcttcttttttctttttgtttttccgagacagtctctctctctgtcgcccaggctggagtgcagcagcacgatcttggctcactgcaacctccgcctcccgggttcaagtgattcttgtgcctcagccttttgagtagctgggattacaggcgcctgcccccatgcccggctaatttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggccccaccccaggcctcctgagacagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctttttttttttttgagataggctgttgctccattgcccaggcaggagtgcagtggtgcaatcctagctcactgcagcctcgacctcctgggatcaagcgatcctcccaccacagcctcccacctaagccccctgagtagctgggactacaggtgtgtgccaccacacccagctgattttattttttgtattttttgtaaaggcgatgttgttcaggctggtcttgaactctttggcctcagcgattctcccacctcagcttcccaaagtgctaggattgccagcgggagccaccctacccagccgaactcctttcttacacgtagttctgacagtatcgatcatccactcttcaaggtgctaatacattaaaacagcaaattggaagtaggccaaggaggtgctagtggcagccccacggacagtagcaattaagaccagttgctagcttgatagtgggagaccagaaagactaaaaataattgcaggctgtgttggtctggtatggatgctgacttcctgacatgtagctaggtggagtggctcatgctgtaatcccagcactttgggaatccaaagtgagacgataacttgaggccaggaattcaagagcagcctgggcaacatagcaagaccctgtctctacaaaaaaatttaaaaaattaaaaaaaattagctgacatggtggcacgcacctgtaagtctcagctactgaggaggccgagatgggaggatcgctggagcccaggagttcgcggctgcagcaagctgtcattctaccactgcactctaggttgggcaacagagcaaggtcctatccctaaagaaatgacaaaataaacagtcaaccacctggtggagaaggtagtattttcaccaacgctgtagcaaatgtcaaggccaagacaaacacttgtttggaaaatttagttttggggaaactcctctcctctagtgtgctggattcatgatatattgttacctggaaatggcagccctcagtggataagaacctggggttttggagatgacccatgtttggcggcacctgatccctatcagcagccatgcgtcccactgtctaggcagtggccaagggtgctctgtcttggacggcagacagcacatctgatttggaatttttgttccagcacttcttagctgtgtgactttgggcactgctgaacctgcttcctccgtgaaacagccagtgataaaactatttactgtgtagaggattctgtgagactcaacgtatggcagtgcctgatgtactattctaaatttatttttatttttattttagagatggggtcttgctgtgttgcccaggctggtcttgaacccctggcctcaggtgatcctctggcctcagcctcccaaagtgctttttcattttctcctcaaaatgagaaagtaaagtgttatggtgttggcagctcacccatagaaactgctttaaaggccaggcatggtggctcatgcctgtaatcccagcactttgggaggccaaggcaggcagatcacctgagatcaggagttcaagaccagcctggccaacgtggtgaaacccatctctacaaaaataagctgggcatgatggcgggtgcctgtaatcccagctactcaggaggctgaggcgggagaatcacttgaacccgggagccagaggttgcagtgagccaagatcacgccattgcactccagcctgggcaacagagcaagactcaaaaaaaaaaaaaaaaaaaaaaaagaaaagaaaaaataaactgctttatattaaaagaaaaataatggtcataatctggccttaggggctatagcatcaatggtgaggcctagatcgcccaggtcactgggtgtgtattgacgttgtttacatgttttatttcttttatgctttttcccagagattgatttttttttctcccttatgtgattcaaaatatctgcttacacgttaaacccagctcagttggcataatgtctttttaaggcacaagccagcttcctgggtgtgagcagcttccacatcaaatgttcagtgggcaaatgaaacatgtgagtcacacaacacttggcacctctgtggcttttaatatttggtggcaaacttcctaccgcgaggagaaaattttcaaagtggaagtcctttcagatccagatggcaaaagaatttgttgggcgagggatcttgattcttaatgttgaggggactaggaatgtttgaattttctcccccttgtattttcccagcctggtaggcctccatgggggccaaatttagttgcgaatttgcccacttttgtgcagagtgaggctccatctatggaatgtgcttaaccataaggatcagaaaaatttctagtagctttgttaagtgcacagcaaacagaagacaaagtgtggccgggtgcggtggtttatgcctgtagtgcaagcacttagggaggcagagatgggaggattgttgagcccaggatttcaagacccagcctgggcaacatagcaagacccccttctccaggaaacggaaaaaaaaaaagagtttgaaaaaagtgtgtagactaactgaacacttgcaaggcaattttttttttttttgactgtctggagagcttgggttccatgaacacaatacagctcttgttccacgtgacttacaagttgggccccgggttttgttttcttggccgagatcttgaagactgtctccaagtaggtgtttcttccttggcagcaggtttggccagttatgtagtcagccctgtccttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggctggtctcaaactcctgacctcaggtgatccgcctgccttggcctcccaaagtgctgggattacaagtgtgagccaccatgcctggtttatttcattttaaaatgcaatttttctgaaggtagtcattgtttttgcatgttttcttttcttcaaaacatttttcatttgttaatcaacattttataaggcttaatattaaaaaagaaccaaccccaccccacttctccccactctcatttcctacacccaagagcagccctggttttctttttctttctttctttcttttttttttttttttttttgagacagggtctctctttgttgtccaggctggaattgccgtggtgcgatcatggctcgctgcagccttgaccaggtataggaaatgagagcactgtgcccggctaattgttgtattttttgtagagatggcatctcaccatgttacccaggtggtctcgaactcctgggctcaagcaatcctcccgcctccgcctcccaaaaagctgggattacaggcatgagccattgtgcccagccagcccctggttttctaagtagcaggcttataccacttgtctttgatatttcagtgttaggtgttgacttactgatgtgttttatgagacatggatgaggattctggcctcagaaaaggctgcctacgcctctctctttctcagaatagtcacatttcacctgtaattccagtgctttggaaggccgagacaaaaggatcaccggaggccaggagctcttgactagcctcggcaacattgcaaaactctgtctctaccaaaataattaaaaataaaaaaattatccaggtgtggtggtgtgcacctgtaagtcccagctacatgggtagctggggtgggaggattgcttaagctggggaggtcaaggatgcagtgagctatgaccacacccctgtactccagcctgggtgacagagcgagagtctgtctcttagaaaataacaaataaatacatttttaaaagcatagtcatacttctctttttggctcaatcaattttcaaatatacagtgtttccatagctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgcatcttattttagatttccaagttttcttattctttgaacatttttatggtctgttctttcatggaagcatcatcttttatattcctggctacattcatcacagttttttaaaaagtttttggccaggcaaggtggctcatgcctgtaatcccagcactttgggaggccaaggtgggctgattgcttgagcccaggagtttgagaccaacctgggcaacatggcaaaaccctgtctctactaaaaagacaacaattagctgggcatcgtggcacacacctgtagtcccagctacttgggtagccgaggtgggaggatggcttgaacactgaaggtggaggttgcagtgagccgagatcacaccactgtactccagcctgggcgacagagcaagaacctgttgcaacaaataaaaaaattttaaaaaagttttcttctgttctctgcgttggaattttttttttttttttttttttttttgagatgaggtttcactcttgttgcccatgctggagtgcaatggagtgatcttggttcactgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcattttgcacacctgcccggcctccaagtcctgcagctcgaatgagcttgcttgctgcaggcggcctgctccatcttgaggcttgtctggaaaggcggcttcggctttccagtgctttccagcgctttccagcttctgagattttgggggcttttcatttgttcttgctttcctgtcctctttgtcaggtgagtttatacctttctgttccaaagcaaacaggatcgtctgccatgttgaactggatgtcggacaattctgaaatgtgtgcatggggcaaggctgtgtgtgatgataccagtttcataggaaacacttcggttttggttttgtctttcaaagtcatcttttgtgagcgccttctagccgggctgccagcgggtaacatatgattaacacaagtttggagtctgtctgcagagcaactttatgaaatgctcagaaagccagtctcctaagcataggagcctgtttggtggtgatgggatgaggaagcagtgggggctttggcaccagaggcctgggctcaaatcctgcctccatcatttaggggttgggcatctccattcccttatctctgggtggcgagaacttcctaagttcttagtgtttggaagggaccccctccataaagtgaggtgcctcttggccactgctcagccagtgggggctgttcctaacagttgcctcctccgattgctggagtaagaaatgacaccctgtctcccatttctgtggcaccccattctcaacagtgatggttctgcctgtttttagtcacacacacctgcacacttcaaaggactaaaaatggactcagttttctttctttttttttctttttgagatgaagtctcactctatcacccaggctggagtgcagtggcatcatcttggctcactgcaacctccgcctcctgggttcaagcgattcttgtgcctcagcctcccaagtagctgggactacaggcatgtgccaccacacccagctaattttgtatttttagtagaggtggggtttcaccaggctggtctcaaactcctgacctcaagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctggccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttctccagggtgctggggacccaagaaatgcctggtcgtttctcataggttgataaggaaaatgaggcctaggtagggacaggcaggatttcacctgaatttacaagatgatgcaatggaagagtcttcagtatattttcacgtattttagaattgagttacaacattcattttggtactttctctgtgttctccccatgtgttaaaaagcagcttaaggccgggcgcggtggctcatgcctgtaatcccagcactttgggaggtcaaggcgggtggatcacgaggtcaggaattccagaccagcctggccaacatggtgaaaccccgtctctactaaaaatacaaaaattagctgggcgcagtggcagacgcctgtaatcccagctactcgggaggctgaggcaggggaatcgcttgaacccgagaggcggaggttgcagtgagccaagattgtgccattgcactccagcctgggcggtagaaggagtttccagctcaaaaaaaaaaaaaaaaatgcagcttaagtgctggtttagcgcctgtaatcccagcacgttgggaggctgaggcgggaggatcacttgagcccaggagtttgtgactagcctgggcaacatagcaagaacccgtctgtacaaaaaataagaaaaattggccaggtgtggtggcgtgcatctgtagtctcagctccttgggggctgaggctgaaggatcgcttgagtccagcaggaggtcaaggctgcagtgagctatgatcaagccattgcactccagtctgggtgacagagtgagaccctgtctcaaaaaaaaaaaaaaaaaaaaaaaaggaaacaagaaagaaaaaagcagctaaattctgctggaagtgtgcagtaaagcacaagttttcagccatcaacgcagggagccgttaatcacgacccataataaccagaatgttattccacggttgcggtttgtttatttcatcagagttgcgtcttcacctatttccctccctactcttaattgtttatccaagttagtgttttccattctttcactgaaggctctaaaaatggtcccatcaagaagtctggtagataatggaagacgaagtggactttacagaaagatgaattttcttccctagagctggaaaacccttcagcgtgtcatgcgttccccagccaggacagacaaagccacgcaatctgtttcctgcaggcccagaggggaaggcttcctccttgtggttagtgacttcaaaagctgtcctcactagagcaagtccaactcttcctctagttctgatgacttcacggcagccaactgagctgctgaacgctgtttttttctacgcagaaaccctcccgactttcacgaggagttgacaggttttcctcttcactcgggctcccttgtcatcgttaaactgaaactgctttcttgtagccaaattctgtggtcccttttcggcctcggcctccttgacctctctgtgtccccaccttggctctcccacgcctgccagccgtaccacaggccccgggtgtgaaccctccctccgcggtcatgcagccacgcctctgctcaagctgtgcctcctcctgggcgcaccctccctctcccatccttcagcctctgaagtcctgcccagctccggttcctgtttctgttaggacgaggcccttcagatcctctccagcaggtggactctgtcctgccccgtaccacccgccgcgggccacttttgggcctgcgccatgttcctgcccttaccccgcccggtgttagcgtcacgtgggtcctgatgtcctccctctcccaggcctctgcttatctgattgggggctgtgcttgactctgaaacccgggcacctcctacagggcattttgcctgtcacaggcctagcattcaatacctatcatatttttgaaatatctgcagaaataaaaagaaataactattttcttcttcaggagttaagatgcgtggccaccaagtacttttcaatacataaaatatgttttcagcacagaaaggcctttcaccgctcttacttacatagtctgcttttggtatgatggggacggatgaaaaatgaggactgtaggcctccgaagtcagctgttttgaattaaagcagcgcacgctttgagtcaggtgaagcgaggatggggtttcacccgttgaggatgaatttgctgggttactttaaactggaactgttcttttcagaaatgagtgaagcaggaagggaaagacggagcttgtctggctgggtcggatgaccccctttgccaggccgtcacccctctaggttgagttagctcagaataacttagctgtgctatagctttgcataattgcaaggagctttgtttcgttttattttgcagggaatttttttccccccttagctcttcctcctggtgtatttgtagaaatcagcttcatcatggtcatttaacagtaagggctgggggtggtggctcacgcctgtaatcccagcactttgggaggccgaagtgggaggatcacttgaggtcaggagttcaagaccagcctggccaacatggtgaaaccccgtctctactaaaaatacaaaaattagccgaatgtggtggcacgcacctgtactcccagctcctcgggaggctgaggcaggagaatcacttgaacccaggaggcggaggttacagtgagccaagatggtgccactgcactccaacctgggcaacagagcgagactctgtctcaaaaaaagagaaaacagaacatactatttttgttgtttctgaggagtagggtttcttaccagggaacctgctttaaaaaaatgcagtatgtagattccttaagaataaagttaagcagcagctaaccaagcacatggctaaaaacccggccaagagcattgtagtatctggttttggggttggtggtggggatcccattttagaggccgactttggtttgtgatggttaggttttactttcttaggtctcagctcacatgtccccttctcagaggagccatcctcacccatcccttcttggtccctcccgccttccctgactttttcttcttcaatgacttatctgcacatgatcccctacttataaaacctgtgtcttccactcctctcacccgaaagaatgtttgaattctgaaaacaatgactttgttcttagcacccacaacagcaaatgctcagtgagccctatgttgagtgagttagttgtgagctgtggtggtttagtgagggtatactttggcccttagaatgcgaatgccttttttttttttttttttttttgagatggcgtcttgctctgtggcccaggctggagtgcagtggcacgatcttagctcactgcaacctccgcctcccaggttcgagagattctcctgcttcagcctcctgagtagctgggattacacacactcgctaccatgctcggctaatttttatatttttagtagagactaggtttcgccatgttggccaggctggactcaaactcctgacctcaggtgatccgcttccctcggtctcccagggaatggctgtttaatcacaagaaagtcttcccttcatgcgttgtgaaaaccagcagtattttaattgaagaaatccggtattgtttggctttctagatttggaagtaggtcaggtggctaatgattgaaaatggaccggcaaccagagggcctttggaaactctagctcgacttcaggctatagttttgtttatgcccttgtcactaaaggcactgcccatgagagctgggtttgcagtccctgctgagcctggggttgagagcagagccctagagtaactcagcaaaggcatccctccctgcacctgagctgggggagaggcggcttatgattaactcagcgatgtctcaaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttcccagccagaaggcttcatgggtagtatctttaagatcctagcagaaggttgcttttctctctctctctctctcagtcctttctttttctcttttctttgcttctttccttctttcctttttctttcttttctttcttctctttctttctcttttcttggcttatttccttctttcctttgtctttctttgctccttccttccttccttttcttccttcccctttctttttccttccctccctccctccctaccttcctcccttccttccttcctctctctttctgtctctctgtctctgcctgctttttcctctctctctctgtctctccccccttctcccctctcctatcctcttcttccttttttctttttttggaaggcccagattagtagcagagactctccttgaaggggatagatgcattgtcgctgtttggtattttgaacagattcttaagaaaatgttttcctggtggaagatttcagacacacatgaggtgagaataatgaaccctgtgtgctgcccccagcatgatcagttccaaactattggcctgtctagtttcatctccgcccctgcctactcctggaattttgaaaaggacatcatattattttctccataaatatttcagtatgtatctctaaaagataatgtcacttcgaaaaaaatacctaataccacgatcacacctaaaacataaatgaacaatatgaaggatgagtttctgctgtgtggcatggcagaatgatgctctgtggggtcccaggggagaggtgagctaagttcagtgtgtcacctgctgtcacctgccatcacctgtcccagggcctggggctagccactgctcttttgtgagcctcagtttcttcatctataaaactagaggattgtactagtctgtctgtctttccttcctttcctccctttcctgtcctgtcctgtcctttcctttcctttatcctctctctcttttatctccccttcctcccttccttccttccttccttccttccttccttccttccttccttccttccctccttcccctctcttcttctctctttcctttttttaaagagacagagtcttgttgtgtcacccaggctggagtgcagtggtgcagccatagctcactgcagccttgacctggtagtctcaagtgatcctcccacctcagcctgtgaggttccgggaacacaggtgggcaacaccatgcctggctaatttttaaattttttgtagagacaggctagtcttgaactggcctcaagcgatcctcttgcctcaggcccccaaagtgccgggtttataggctgagccactgcacccggcctgcactagttttttttgtctctagaaatctgcatctctgaatgtgttaggtcctgacctgctttagaacggatctcagccaccctgctccttcgaacccacatttctgccccgtgtctgctggtcgcaggaattggcacattttcctttagctgcgcccaccagtccttgcacgcatactcctggtcacttttttaatgtctggcagatggtttcaagtgcaatggcgtctctgcgtaatagttgattctctaaagaacagagtctactaagtggaagctgcgtttccacatttagcagttagctgttaagagccagtaacaggtgcaaatttgcaacccgttttttccccaatcttttggaatggaaatggttcagtcatttgaatttaacaaactgcctgcccggcatgcactgcagatgctgggctgcaaagctggttttggtgctggttggccccctgggtgcccctgtctactgagggtgggacaggcggaggactgggggctcagtgctgcagaggcacatgtagggtggggtggggtggggtggagaagaagtcctgaccagtcctgatttggtggtgctggtgcttatgggctagtgagatttctgcatgcccaggctggctggtagccatgtgtcagtcactcataatcccagtaccagagttatcatcacccctaacttttttttttttttgagacggagcctcactctgtggcccaggctggagtgcggtggcacgatctcggcttactgcaacctccacctcccggagtctccctctgtggcccaggctggagtgcagtggcacaatctcggctcactacaacctccacctcccgggttcaagcgattctcctgcctcagcctcccacgtagctgggattacaggcgcctgccaccatgcccggcaaatttttatatttttaatagagatggggtttcaccatgttggccaggctggtctcaaactcctgacctcatatgattcgcccaccttggcctcccaaagtgttggggttacaggcatgagccactgtgcccggccacccctaatgttttgatttatttcctttgaatttttttttctctgaataaatggattgatgatatctattgacatagtcagaaactcaagaaacatctatggagcatctagccatggagcagacactcctgttggtctcgggggtgtgtggcgggaaggtcagagtccttctagtcctccaagagcttccagtctggtgggtccctagaatataatacattgtgtgttgtcgtaggcgggacttgcacgctgtgcagttggctttacggttgacaccaggccaccagtggcctcctccgcctgcccttccagcctgcggttgtccttcagctgctgcctgtgaaatgtgatcctttccataagtccccagcacagagactgggaaggcagtttctaagaaggcccttctgttgggctggctcagaacctgccccctttcctctgacttgcctataaaaaggtgggtttttcctcctgcctataaaaaggtgggatttcacactgacataatttacatcgagggacatattaaacctggtgtaatttgcaagtgtgccctgaacacgtttcatcatcaggctcgttgtggagaccacggtgtccctttccttcccatcgtaagtccccggtgtgtgtgtgtgtgtggaaagtttagagctcccaaagtttagagctcagagaggataaagacccgtattactaaacttatcaggaaaatgtggcttcagattattttttttcacagcaataattgcatttcatgtattttttttttttacttattacagaaaatttcaaatatatacccaaacagaagaagatcatgaatgcttttgtgtccatgactcagcttcaataataattatttacttgtcgctggccttgtcttatctgtaactttctcatcgctcacccgacttaaattttgaaacaaatcccagacatcatatcttttgccatccacagatacatcagtgtgtatctctaaaagagaaggactttgcaaaaagtacaaccacaataccattagcacaccctcgaaaaatgacaaagattcatcaatatcagctatccaatatcaaactgccactttcccacaaatgtcataattaaaaaaaaatttgtttcaatcagaacaagaaaatccaagtgagattcaagagtcccgctgggactggttcatgtgtctttgtcttttgagagttcttttttttttttttcttcttttttttttgagatggagtctccttctgtcgcccaggctggagtgcagtggcatgatcttggctcactgcaacctctgcctcttgagttaaagcgattctcctgcctcagcctcccgagtagctgggattataggcatgtgccaccatacccagctaatttttatatttttagtagagacgaggtttcgccatgttggccaggcttgtctcaaactcctggccttaagtgatccacccgcctcggcctcccacagtgtggggattacaggtgtgagccactgcgcccagccagggctctttttatattgcaaaactgaaactctgcacccattaaacaataacactccatttcttccccaccatgccctggcaaccatgattccactttgtctctatgcctttgaccactctaggtccctcgtctaagtggaatcatacagtattgtctttctgtgactggctcagttcacttagcacagtgtcaaagttcctccatgtcgtagcttgtgtcagaatttcctttctttctaaggctgaacaatattccgtggtgtgtgtataccccattttgtgtattcattcatcaatcagtggatgcttgcgttgcttctaccatttggctgtggtgacactgtgtgaactctggtgtgtatatatctcttcaagacccagttttcgtttcttttgagtttatacccaaaagtggaattctgtttgggttgcaccattttaaattcccaccaatggtgcacaagggttccaatttctccacagcctcgccagcatttgtcattttctggattgtttttttttttttggagacaggatctcactgtgttgcccaggctggagtgcagtggcacaatcatggctcactggatccttgacctcctaggctcaatcaatccatccacctcagcctcctgagtagctgggactataggtgtgcaccaccacaccccgctaatttttatatttttttgtagagatggcgtcttgctgtgttgcccaggttggtcttgaactcctgagctcaagcgatcctgctgccttggtctcccaaagtgctggggttataggggtgagccaccatgcctagcctggatttttttcttttttaatggtagacatcttagtgggtttaaggtggtatctcattgtggttttgatttgcatttccctaatagatagttatttttatttttatttaaagggagtctcgctctgtcgcccaggctggggtgcaggggtgctatcttggctcactgcaacctctgcctcctaggttcaagcaattctcctgtctcagcctcccgagtagctgggactacaggcgcacaccaccatgcccagctaatttttatatttttagtagagatgaggtttcaccatattggtcagactggtctcgaactcctgacctcaggtgatccacctgccttggcctcccaaagggctgggattacaggcatgagccactgtgcccagcctaatagatagttatttttaatacttatttaagcttcatgtttcaactgggggtgcttcatgatatattaatatttaatgagccaccttaattatttctaaaaaagtaaaaaagggaaatactatctcccacatggtattattcatgatgtatatcttttttttaaatgttttgtagaatcggaccaaaatcagaccaatcctctcagtttatcacaaagataccaaaacccagagagaatgaggctttgccttagcctcggccctgggagatagaagaggagcctggggcctgggttccccctgccgtggctgcccagtccttccgctgacaccatttcgaggtccccttgtggaacttctgtgggaggccaggtgcacaaagtccggtttgttgagctacagatgcccgccagcagttgctgttattatagactggttgttctgatttgtcaagaaacccagaacaactgtttttcttctttgcagtggatgtgtgtgcacatgaccttttgagaacatatttcctgatgtggtggaggcactgatgttcgtgcagactagctaagttaaatcttcatttctttcagctgaaattgcctggctgctcctttaagaagtgcactgtgtggagttatcatgtttctcatgctgttaaatgtttactggcaatcctgtctactttagcgtattgttgtcaaatgacaagggagtcccctgtcagagagcaatgacacagcctgtacttttgggggcagccagcgtccgagcgtttccacattcattcttacgcagttggtaggctcaggatgtttgtgaacgccgaagggtgtgcgtgcaccctggagtgtggagatactagcatgctatttaatgatggccaccacgggacgtgcgcactcattcattaagctaacgttttatggtttgttgagtgaaagcaggcacaatggtaggtagtgggtactggagcaaatgactgcaccggccctcatgggacttccatttcagtggattcaggggaaagcagcacgtgtttttgagagaccttggcaacgcaggcgaccttgacgtcgaccaaaagaagagagatttggaatgcttgttttacagcctccggtcaaaaaaaatcatatgggaccctttattgcagactggaacatttatttcaaggtctcaaattaaactagaggaggccaggcatggtggctcacacctgtaatcccagcatgttgggaggctgaggtgggaggattgcttgagcccaggaatttgagacctgtttgggcaacatagtgagaccccaatctctactaaaaaaataaaaattaggctgggcatggtggctcacgcctgtaattgctgcactttgggaggctgaggtgggtggatcacttgaggccaggggttcgagaccagcttggccaacatggcgacaccccatctctacttaaaaaaaaaacaaaacaaaaattagctgagtgtggtagtgcacgcctgtatttccagctacttgggaggctgaggaactagaatctcgaacctgggaggtaaaggttgcggtgagccgggattgcaccactgcactccagcctgggtgactgagtgagacgctgtctcaacaagaacaaaaactaaccagttgtggtagcacttgcctgtagtaccagctatttgggaggctgaggtgggaggatcacttgagcacaggagttggaggctgcagtgagtcatgatcataccgtggcattccagcctgggtgacagagcaagaccctgtctcttaaaaaaaagttaaactagagtagataaatgagcaggcatagttgtttgctgatcattcaccgttgagacaatgaacagctcgttaaataaattgttggtaacaatgaaatcaggagaatttcaatcctgagtcagtgtacacaatacaaggcacaaaacgttgagttaaaggtggttctactttgccctctaagcattttattgacttcaaaacctacaaaggcggcgccatggcatataggaatataggaataaggcatataggaataagaagtttcaaaaagtttcataaaagttgtatttggggctgggcatggtggctcacgcctgtaatccctgcgctttgggaggccaaggtgggtggatcacttgaggtcaggagttcgagaccagcctggccaacatggcgaaacgccatctctactaaaaatacaaaaactagccgggcgtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtttcgtaatgtgctcgccctgccccaggcatcaagggaggtgctcactctgtgcactctgaatcccaccaggggcccacctgccaccctgttctcacctgtgaccactcacggcagccacaagaggcacaggtgttaggtctgccccagccacaacacctcagcacgtggtgtgtggcttcaaccaggtcaccgtgggcacactgggaggggagggcttctgtgcggccacgcttaataaacagtctgcctgggaaactgagcatccaaagtgccctctgaaggagcgggatgctgctgcccgtggtggctccgtcacacgcattctggaaggtacctcccggtaagcaacctgatgtttcatctgtcactgttgatgcatctccatgttagagaattaagcatatggaagcaaaacacctcaggaatacagaacgcattcatgatcaccacggaaaatcaaatcaactcaaagtccaaatgcaactttttttttttttctgagacagggtcttgctgtgttgcccaggctggagtgcagtggcacgatctcagctcttagtagagatggggtttcaccatgttggccaggctggtcttgaactcctgacttcaagtgatctgcccgccttggcctcctaaagtgctgggattacaagtatgagccactgtgcctggcctctcttttttaaaaaaaatagagatgaggtctcgctatgttacccaggctggtctcaaactcccggcctcaagcgatcctcttgccttcacctcccaaagtgctttgattacaggcgagcttttctctttttaagccaacttgtgagtagaatcattcacttgtgcctttagctgttgtctctgtgttgaggaatccagagtccagtccttctagacttatctggggacccgagtttccttctgtagagttaaaacctgttgcatccatccccagtccctttacggcacctgtgtaggcctgtagtggagctggcttttgtcctttgctgtccctggctgagccttggcctcatcttgggccagcgcctcctcccctgggctgctgtgatgtgttggcatttcctgggtagagtcttgtacttgctgttttctcctgtctcagtcttttcccccagggacctggcatgtctgtgtgttggggaccctttgctcatcttacacactgaggacaggcaccttagcgcttggtgccctgggatggaacagccactggacagccagccctgtgccctgtgtccactgcaaacctgatcctgttttttggagcccttcacttggcaatgagaccttcatgggtggggttactgaagcaggagttggtttaagttaaataccatcagccgcaaagctcagaatggatgatgaagtgctttaggggttgacagggcagagctggctgtagggagtgatggagagaggctcccaggaggggaaccctctgacgtgggagttaaaggactggggccatttgtcgtggggggatgggagcagtggcttgggaagggacagaacgggagcaagagggccttgcgcactgatgcttttgaggactgaatctgaacgggagagtggggagagggctggaaacctgggcgagaacaggagaggagaggcccctggatgccagcagagctgtaggcatgatctgggccatgccctgggagacgcttccgcaggagatggtgcggctggggtggagacttcctggcttccgagggcgggcgagggggcaaagggcctggggcatggacttgggcaggtagcaaaggccagaaggagtgggagtcattccacctgggatgtgggaatggctggtgggggcaggtagggggagaccaggatgagccccatgtgcgcgtgacctgtggcagaggggctgtgtcagagccccggctggcgagaggagcatcactgtgtccagaggacgcggtgcctttcagaccccttgagtaagagacagagtgggtctgtcctgtctaggctgagttttcattgcccagcacagtgcctggcacacagtaggtgcttaataaacacgtggactgaacacaagaggttgaggggaaaggtcggaattggccacaggtctcctaatgcctggcatgtgcgtcaacgcatctctgaggatggaatttaaaggcaagagctggaggcccagggctgaggctgtggggtgagcacagcatttgcggggcgcgggaagggagtggctggtggggcgggggagggaaaccagcacgttagaaggtcagccaaggtcaggcggccagcagggcgggaggaggcgttggtgtgcacacgcggggagcctccgtgtcctcaggacaccatggaagacggcaggacacacgtgcgagccacagcaggtgggcgggagctcacaggctgcagaggaagcgcaggggaggcgcaggggaggccaggctctggcatttcccaggaatgtaaaccccggtttcagctttccccgtggctcccctccgccaaatcttaaatcctcttgttaagacgcgctccgcccctgtgtccttatttcccaccgtggtgggcagcttgtctgccatccccttccaggtgccccgcagaaccaccacccttgggaaggcggctcctcgtgccccccctcttgtgccttccctccccagtgccttttctgaccccctcctgagaccgcctccctgtgggccatttgagcacctgtagctttccatccggtgtcttcacccctttgctctttgtagctgtctcaccccgctgcagcttgtgaggccatgcaggccctgatgtttagtgttttttttgtttttttttttttttttaaagacagcatctccctttgtcacccagaccgttgtacagtggcaccatcctagctcactgcagcctcaaccttctgggcataagcaatcctcccacctcagactcctgagtatctaggactacaggctcttgcacccaccacaccgggctaatttttgtattttgttgttgttgttgttttgtggagacagtgtttcaccatgttgctcagtctggtttcgaactcctggcctcaagcaattcacccgccttggcctcttaagtaccgggattacaggcatgagacattccctaatgtttagttttaaagagggggtggtgctatttatctccaggctcaaagcagggcattctttccttaggatctgcgatactccagtcaaggctgtttcttttctgccttttgtaaaactcttgtctagaaattaatggatgagggaagctagggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttacctatttttaagcaagtaatataatctcttggttccaaaaacaaagcataaagaaaagtctcctatctgcctacctccccacccactgttgttgattttttggtgtgtatccttccagagtttcattatatacacagaaacaaataccagtgtcaccctcctttgtatgcacatagtctagcatgccatgcacactcttgtgcaagtggctttttattttttaaaattaacaggccaggtacagtggctcatgcctgtaaacccagcactttgggaggccaaggaaggcggatcacttgaggtcaggagtttgagatcagcctggccaacatggcaaaaccccgtctctactaaaaatacaaaaattagctgggcatggtggcgggcacgtgtaatcccagctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggacaggaccctcccctccccttggttattttactaacttggaataacgccacttccttgtaggaaacaggcagtgactgtcagtgagtgtgcctaggagaggggtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaataaagagaaaaaaaagacgcaccagcggcttacaagatctttttttgtttttttttttaagagacagagtttcactgtcgccgaggctgaagtgcagtggtatgatctcggctcactgcaacctccgcctcccaggctcacacaattctcctgcctgagcctcctgagtagctgggattacaggcgcgcaccaccatgccgggccaattttgtatttttagtagagatggggtttcgccatgttggccaggctggtctcaaactcctgacctcaggtgatcctcctgcctgggcctcccaaagtgctgggattacaggcatgagccactgcacccagtcacgagatcttaaagtagaagtaactatggtatttttttcgagaattctgttagggcgagaagcccattcgtactgtgctggaaccatcctgaccctgtctgttctttgcaggaactcaaaccaatatgcctaagtagctgaaactgttgcatttcaaagccttttcaagcatatcttgaggacactgttccctgcagctgaactgaagtcttgatctgagcccaggaggagtccctggggttgtcttgttgggggtggggaagtgggaatgcttgcattcagctttgggggaccttaaccctttgccccctcccctgtccccccttcacatagctttaacatgaaagtctttctgtctgtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttggctgtcccagttgcttccctgtggctgggagcccctctctgtggttgaggctggtcttaccattgctccagttgtcttcggccttctggggcttacttcccctgccctggaggcctgaggccagccagccagtgtggtgtgacccccctgacagtgggctctcccggctggcccagttgagggtggtcagttccttttgtggccttgccttcttgggagataaaagtggccccctgggtgccgtgcggcccgcccgcagggtccttggtggagctccagcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggttcacgtgatgaaacacaggccatgacccctttaggaattggatggaagccagccaggccaggccccccacccccaggtcctgggttggggctctgtgggcccaaggagtcctccagaaccaaattctccactaagagcaatttttaaaagagcagctgctcatcccatgtccaattagagtgagcagatgtgtaagaaacatgtctttgattgattttgggggagccccccgcagtttgatgttttgcttggaggtaggggaaacgggggctgagttacaagtattacctgtaggaataaacaattcttttgaaacatcagtagggaagaaagaaaaaaaaaggcagcttaagatttatctaaaaaggaagtggaaagttaaagttgctggagatctcattactgtctgtctcgctcaccgtaattaaaaaatgcctgaatgatcttaataacacatgattcagctgacaagcactaattgccctgtatcaggccaagagaagatgaatgttgtcaagaaaaccacaagtcagacaagctgattctctgtgagtctgacaccgtgttcccatgtacagaccagtttttactggagttcttccagcatcaaaagcagcttcttaccttcccattaattttcatcgctggcaggcccgagttgtttgcgatacactgactacctcccttgattcctcctcgctggctcaggagcttgggtctgcagacaaaatgtaaatatgtttcttgctcttatctttgtcctttttcagggaagaaatctgttcccgtccaatatgaatgccctggtgggcttgtcagtaaattacatggtatttgggaattgattttctgacgccaccgatttgtcaagaacttatcctgccttttcagcgatttgacagcacctgttaggctgtagggccatgtgattgggcagttctcctgccgagaaaaaggggactgatgactttctgtcacttgggcatccagaaacctccttgaaggtggaggttattgagggaggaggcaggagtggaaaaatgctattggtttattcctgtgcttttatagaacagccgaaccattctatggcaataaaacagaatcacagggcaaggtgcagtggctcacacctgtcatcccagtattttgggaggctgaggcaggaggatcgcttgagcccaggagtttgagaccaaccttggcaacatagtgagaccttgtctctacccaaaaataaaaaaaaaaaatcagctgggcttggtggtgcacgcctgtagtcccatctcctcgggaggctgaggtgggaggatcgcttgaggctgggaggtgggagcttgcagtgagccatgatcacaccactgcactccagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaattaaaaaagaaaaaaagaccactctaaaggcatttgtgcatgaagacacctacagaaataaagccggggtgctgttcttggtcttcattcaggctagcacctctcgtcaccttttcactttggagctcagggcctggttcactcagcaagtgagcggctcacacagtagatgctctgcacatagtagtaggtactcagaatatagcagctgttgatgtacatgtttccagaggggccaacacaggaatctgcacgtgggtccttgctttaagcccagcccctctctgtgggcgtgggatggagtcttcctttcttggtgaccggcgccctctggggtcactggaggcctggacttccccactggcccagtgaccttgtttccttgttccctgtctcgcccagccttggctgtcctgggatttgaaaatctgggataaagcctttttcgggcctctaaggccctgctggttctgcgtgttccagagagctgcacctctgggtggtgagctggcctttttggcatttgatttatgtatagccctgagtcactgggagcggatctagagtccaggccagtgactgatttcaaacgctaacactcttggctcgggctcaggtttcaagtcagcctccaaaggggatgtttgctcatttcgtcatcttcctatcacagcaattttcgtcatatggaggggtggcactcatgtaccttgatgattattattcttttaaaaaatgaagttatttatgttatggggtgagttcgtcacacagtccgaatgtggaatgttgccatccttttcatcccaatcctgccagtgatttctgtttacaatagaactattgacattgtatggggatgaaactagcatgagatagtaattgttggcttgcctgagattttcatcatatgtacacatagacaaaacctggctttagttcctaaagctattgctgtttattgtacttttattagccaatgttacagatccccgtagcatgccagaggctattaagaaatacaggggtcgggggcaggaacgaagtccctggccatggatcatgcaattgatctatagttatttttttttctttttctttaatttttttttgaaattttaaattattattattactgttttttgcgatggagtttcactcttgttgcccaggctggagtgcaatggcatgatctccccctcccaggttcaagcgattttcctgcctcagcttccggagtagctgggattataggcgcctgctaccatacctggctaatttttgtatttttagtagagatggggtttcaccatgttggccaggctggtcttgaactcttgacctcaagtgatccaccgacctcgacctcccaaagtgctgggattacaggtgtgagccaccatgcccggcccaaattattattattttttataagataggatcttatcacacaggctggactgcagtggtgcaatcatagctcactacaacttccaacttttgggctcaggtgatcctcccacctcagcctcctgagtagctgggacagcaggtacatgccaccatgccaggctaagttttaaaattttattttgctagggggtctcgctgacttgcccaggctggtcgtgaactcctggccacaagtgatcttcctgccttggcctcccaaagtgctgggattataggtgtgagccatgcttttggccaatttttagttattgtggatacataatagttgtacatattcatggagtacttgtgatgttttggtgtaagcatacaatgtgtaatgatcaagtcaaggtaattgggatatatacttatagttagcctacagtcttattgataatgttctcagaaatttctgattccagagctccttgctcctctcccataattagataacgtgtttttctgtccggtaattgctgtagtactcatttttagatggggtagggaaggccatgtgccatgttggggcctcatcccaaagaccttgtgctgtttgggacaggtaattatttaaagccccgtgtgaggtgggtgggtgttaaactcatgctctccacaccttcccagagtgcctgggaaagcaggcttctctaagaaagtggaatagcgaataggcagtgatccctgagagagatacataatgattgtcagtttcatggattacagataattccgtttaatgtcctctgtttttcctttttgcaaatttctatgcattatatagaacattgactttagcatagaaagtgctaattcttgatttggcactttaatggatatttacacagtgacaccataaacattggataaacagaggatttgttttaatgagatcttcagtgatttgaagccgtttcccccttgccttctggaatccccggctccagttctgcctggttttggtgatgctgtcacagtggagggctgactgcaggcctcgactgtgagccctcactcggccaccttttcatttcctcgctgggttccaggctctttgaagcactcgcctcctcccctccctgcatgtcctctgtagtgcctatttctgtgatttgcatatagcggaaatatttgttgaactgaattatttttacacacaagcctttcatgtggccaacattttgaggtctgtctcctttggcgggagtctgggaggaatcttccagttcactaagaagtgtttgatagcttcagggcaggcgtgccctgattggggctggatgccctgcctccatccagaggctctctggccaggaggggaatgaaccaagtgcccagattcccccctacaatgtttatgcagaggtgactgtcacctgccaatggtgacagtccaccagggaagtccagaaggcctttggattaaagctacaggagaggcaggtccccttgcagggtcagaaggggaagagagaagagagagagaaccaaaggtgggaggttcagctactcgggaggctgaggtgggaggatccctcaagcccaggaggtcaagtctgcagtgagctatgattgcaccactgctctccagcctgggcgacagagcgagaccctgtcccaaaaaataaaaaataaagatggaaagatgggaggattctccccaggaaggcccaggccgcagggtccccttgtccttaaaggccagctcagtgaggctacaggtccccttgccccagttccccgagcacagagcaggcatggcctcggacgacttcctctttgtgtctcgtggactactcaataaatattaatgttttccaaagatatcttgcccagctctccctgacgaggctgttggcttgaaggaataacaacactcgttgcactcacggaatattaagtctgtgccagggcctgttctgagctcatgacttgtgctactcggtctctccccacaagctcacagggcggatgctattttcaccgccgtttataggagaggaaactgaggcacagggtccttcagtgactggcccccatgagcaggcagcacatctggaattccagcctgtgcagcctggccccaggatccccatgcctctgtgggggacactctggaagtgacaggtgaggcacttctctggcctctctggatctcctgctggccctgaatgtgggtggttacccttttggggtgctgtcggtgcctcttagatgtctcagtgaccctacagggtctgccttccataggactgcctttttctttttttttgagacaggttctcactctcctgccaaggctggagtgcagtggcacaatctcacctcattgcaacctctgtctcctgggctcaagtgatcttcctaccccagcctcctgaatagctgggactataggtgtgcgccgccatgcccaactaatttttttttgtagtttttttggtagagatggggcttcactgtgttgcccaggctggtctcaatcttctgggttcaagtgatctgtccaccatggcttcccaaagtattgggattacaggtgtgagccactatgctcggccggcacccacctttttgtggacttttctttgttgacttggcattcggcaaggtgtaggcttttgccaccaacacgatacccgtggggagaagccccctggcccccgtgcctgccagaagaaaggcttagggtcccctgcgaggacccacacgtgcactgcatgcctggatagcccatgccagcctcactgaggctggatttagttcctgagtatgttatggagaagtgcccagagcagggaccgcaggcacaaggtgggcctggcctttggaggaggctgggcacggccacctgctcctcctctctcccatgggcaggttggccttgttgccattggaaactcttgagagcccacgggtgttttctggccatgtgacctaaatgggaggcttgctgaagggtagatgctgcttcaccagcaacaagaggagcccccagacctcagccacaggatggcccccaccctgctgagcccccactcttcgctccctgctcagcagagcaacacataccattgcccaaaggatggaccaggcacagcgtggggcccaatagcaaatgttctgacgaaggaggtcagtgccggacactgctgggcgttgttgagtcctgggctggcagggacagttttgcagggacggtttggaaggggctttgctggggagggggtctctaggaggggcagcccctgaatagggcagccgagttgctgtgactgcatcttcctttctttccgatgggggcaaaactcactcttctttttaaccattctctgttatctgtttttcttttcttttgaaactttttttttctttctttttttttagaaagaggatcttgctctgttgccaggctacagtgcagtggtgtgattatagttcactgaagtcttgatctcctgggctcaagcagtcctcctacctcagcctcctgagtagctgggactacaagtgtgagccaccatgcctggataatttttattttatttttttagagatagggtcttgctatgttgcccaggctggtcttgaactcctggcctcaggtgatcctcctgcctcggcctcccaaagtgctgggattacagacatgagccactgcacccggccatgtcctctttttctgattcgggaggataagggctccccatgacactggcatcagcattgggagcatttccgtgaccccagggctgctgatacaccctgtggacagggcaggacccacagctaagtcagtaaagcaccatcctctgggagtggctgtcatacgacatttcttgcttttaggaccattggactgaaaaaccaaatcctgccactggatctggtgatgacggtgacatttttttttttttttttttttgtttagaagcttatgattcatcggatctcttttggtttacggaaagcccagatgtcgtggtccctctgcgtgcccactccaggagaacgcattcaatgtcaaggaaccctgtagtgtgcaaagttggatttagggatttcccgaataaagctcactgagggtcaatgagttccataaacattattgaggccgggtgtggtggctcacgcctgtaatctcagcactttgtgaggctgaggtggggggatcacctgaggtcagaagttccagaccagccctgccaacatggcgaaaccccgtctctactaaaaatacaaaaatctgggtgtggtggcacattcctgtaattccagctactcgggaggctgaggcaggagaatctcttgaacccaggagacggaggttgtagtgagccgagatcgtgccactgcactccagcctgggtgacagagtgaggctccgtctccaaaaaaaaagaaaaaaaaattattgaatgtcttccttgtacctgacactgtgctttatcccatttaattccactggataatatgttaaattcagacttgttcgtagatttatatacatgtacatatccctcttaatacattggtttattctgtttctccatgttcataccgccagcctgatgcctcatttgcacaaatgaatggatgagtgaatccagcttattcttttatttctccctgggatctggtatacaagagatggttattttttaatttgagacagagtctcactctgtcacctaggctggagtgcggtggtgcaatctcagctcactgcagcccctgcctcctgggttcatgtgattctcatgccttagcctcctgagtagctgagattacaggtgcacaccactatacccagctaatttttgtatttttggtagagtcagcatttcaccatgatggccaggctggtcttgaactcttgacctcaagtgatccacctgcctcggcctcccaaagtgccggaattataggggtgagccaccacaccttgccaagagatggtcattaaagttgaattttggcactccttgcagaaaccctacaaagttggtatcacctctattttgcatatcagaaaactgatgctggccaggtgcagtgactcatgcctgtaatcttagcactttgggaagctgaggcaggaggattgcttgaggtcaagggttcaagaccagcctgggcaacataaccagaccccgtctctacaagaaaattaaaaaatgagttggatgtgtacctgtgatcccagatacttaggaggctgaggtgggaggattggttgagtcctggagtttaaggctgcagtgagctatgattgcaccactaaattccaacctgggcaatggagcaagaccctgtctcaaaaaaaaaaaaaaaaaaagtgctgagagagatcgtttcccgagggtctttggatagtttgtagaaaaacagtactgttccttctaaagccctgtggctttttccctattccaggtgcacattggcctttgaggctggaaaacacttttacttacttccagctttatgggattcataaaatggccttgagaaaagtaaaccgatttttctccttctaaaaacatccagtgggccgggtgcagtggttcacacctgtcatcccaacactttgggaggccgaggccggcggatcacttgaggtcaggggtttgagaccagcctggccagcatggtggaaccccatttctactaaaaatacaaaaaattagctgggcctggtggtgagcacctgtaatcccagctactcaggaggctgaggcaggagaattgcttgaacctgggaggtggaggttgcagtcaggcgagatcacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatggggttgacggggagccctgaagccggcagtgtttagagattcaaagaataggggggctgtggggagtcttttggttcacagcagtgtcccccaaaccggcacagtgggatgagagtgggctggccagggaaggggacagggtgttaggtccagaggtgctaaaatccccaaccatggtcaaaatggggacatgagagactcggggttcagagctcacatgaaggacagctgtccccccctccacccccgccttgggtcagagctggctaggagagcccaccctgcagcctgtccttcgtgggaatcagcatgaggggtgcaaagtgctcagcaaggcccggcaccaggtttgttcttgggatcagagtgatacacgcgccttacattttttttaagctgctggttttgcgggtcagtacggggaaaaacggtgagtcccttttataaaatatatagagaggttggtgcgaaaatagcagcttgtttctgcttgcgtatttctactcactgctgggacacaaatctacccttccattttctgaattgtattcattcaaactctgatttaacctctatttagttaatgaattgggcaagttaacctcgaactcttccaggctgtggctgttaccgtcaccatctcctgcttctcactttacacactcatatgagaccttttttatttctgaagtgtggcctgacattgtttaggctgttgtttggtgcttatttttaactcttcttttgtcacttaagtaggatgtcttaattcttgtttagtgttagatcacttagcaggattttttttttgagcgggggcggggggaatatgattttgtgtcacattttgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagacagggtcttgctcttctgcccaggctggagtgcagtggtttgatcacaagtcactgtggcctctaacttacatgcttaagcaatcctcacgcctcagactcccgagtagctgggaccacaggtgctcaccaccaggcccagctgacttttgtattttttctagagacaaggcctcataagtagttgtttcccaggctggtctcaaactcctgggctcaagtgatcctcctgcctcagcctccccaaagtgctaggattataggcataagccctcacacccagccaggactggatcccttgactcacttaatgatcggggtttacttctgacctgcatggggtgctgtggggaacccagagatcaataagacagcccgtaccttcttggagctgtatttagcagggtcatagaagacgcactcataatcagaaaccatccagaatgtgacttctggccagggagaatagggaagggttcatggagatggtggcatttgattgaattctgaatttggggttgtaggtttcaaatattagtttggggacagtcatccttttattttcttctctaaatttaaagaaattgttatttttaaaaaccaattggaatgggtattgaatttctgtgtggagaatgtctaccagtttttcatcattttctccactgtatagtgtcaataagtgttaaatgcaatggtctgtaagactttgttgataattttcttttctttgacatagacttgtaaactggaaaccctgtgtgggtaatgggcagtgcctatttcagcatcttgtccccagaaatccactccctaaaaggcttgttgaatgaatcagatctaggagcatctcttttgtgttggagcggagagtcagtccggactttgagcctctccttgcactgaccagcggcaggctgaagacagttggacttaagaaaacttaatctagaagcaatatgctggtcagattctttcaatgctaggtttagtatcgttcctttttctcccatttggtgaagtggtgtaatgctttagcacattttaaataagattacacaagcggctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaattgaaaaatgttgttaaaatgtgctttctgttcctatcagtatgttgttagtgcttatatagccatgctcgagtcagtgaaaattggtgccctttgccaaaatactttttttcatttttgtgtataattttgtgagctaggtctatttttgtttaattaggccctgcaagagaatgagggagagctgtatttaaatttttagaccattaaagggcctaaaactatcctagatgaaaggcccccaaaattagctttaatatttattatatgaataaaaccaatagggaaaacgtttccagaaaccctttctctttttccttcttcagacagctggctaagattaattgcaggcctgaacgtgggcatgtttgctagtttctcttgttctattactagaaaataactcttaagagaggagagaaataccgtcttcttgtatttggggggcaggctgtacattttataactcactaatataatgaaatgtttgttgataacatcatattttgctttctgatagaaaagtcctaatttctattttctttttactttttatttttattactttttttttttttttttttttttttttaaaatagagatgagggcttgctgtgttgcccaggctggtctcgaactcctgggcttaagcaaccctcctacctcagcctcccaaagtgctgggattacaggcatgagcaactgcgcctggcaagtttgttttactttttatttttattactttttgtttctaatttctactttcgacaggattccttttaaaattttaatctaggaaacaaaactgcacgtgaaagatttgccttgtagacggaaagttctggaaacatcagctccaggctgtggtgtgaagctgtcgggctgatttgcctggtaagaagcgcgtttggggcacggagggtcaccttgccccctgcgagcgttctttcatcatttgagcagccaagcatcccttttgggccaagtttgccaaagactctaacgtagagaagtggacagacccagttgcatgctgatgttaggggcagagagaaagaaggaaagatccttgcctagcttaagcccttgtgcttcttccccacatttatttgacttcccaaattggattggctgttgtgattgaaaagattgtcagcactatgtaaatgagaatgagaagtaaaagtgcatctcatgcagataatttctatgtagataatttgccataaaaatttatattgcagtccttaaaaccttcggagatttagtctgtctagggaaaggtgatttatacggcattaaaacactttttatgtcccagtcctttagatttaatgtttattgcctataaaaatgaaatcttcttgtggatatttaaaagttttggtactgtgtgaaatatatattcaagttagaaatgctttggagatgttgtaaataagtggcaaatctcttgctccaaagtccactgtgttgtctgggcccgcatcttggctttgcacgcctgaaaagctgcctcgggtaccggtgtctgatcatcaccatagtgggtcgccaagtaggagaatgtcttatgtagggatttggtggtttttcaaaaaacttaaattagctaacaaggatgggactattataattcctcagaaagttatgcaaggtctgaccagaatttcattccaatctgcagaaagactgaattatggtgcagtttttttggttttttgtttgtttgttttttgagacggagtctcgctctgtcgcccaggctggagtgcagcggcacgatctcggctcactgcaagctccgcctcctgggttcacgctattctgcctcagcctcccaagacgctgggattacaggcgcccaccaccacacttggataattttttgtatttttagtagagatgggatttcgccgtgttggccaggctggtctcaaactcctgacctcaggtgatccacccgcctcggcctcccaaagtgctgggattacaggcgtgagcccctgcgcccggcctatggcgcaggttttaaagagtggaagtgctttgacaatggaatgcccagtacaaagcagtttttaggcttttgcagccactcagattcataacagcacgcttcaattctggtcttaaataaaactctcatggagtaaataaatcatatggtggggacagcactgctgtggaggagggtactgtttaagcattttgggggttcctgaaagatgtttctcaaagtgagcgctggagaggagtacctggtttgattgttgaactaaagtgtggtttctgtaaccctagggagttcttccctaggtatgattgagctccctgagtgctgggatggtgacctccccagcctgtctccaagtctgagtactggtcggcttcctagactccttaaaacgctgggtattttatttaattaatttatttatttttgagatggagtcttgctgtgtcgcccaggctggagtgcagtggtgcgatcttggctcactgcaacctctgcctcctgggttcaagcagttctcccgtctcagcctcctgagtagctgggattacaggcatgcaccaccacgcctggctaatttttgtatttttagtagagacggggtttcgccattttggccaggctggtcttgaactcctgacctcaaacactgggtattttggaaatcatgtgggaagtgcttttcctagagttttgtagctcctcaaaaaggcagaactaatcaaccaggcttccccattgtagccacagttggatcccaatggtaagggccattgggaaaccaatggtctgggtgagtctggcctgggaccctggcatggggaagagactggacttgaaggctttggatgggcagcttggtctggacagtattggaaataaaggaacttgagactttgaaattgctgtgatgggggtgttctcacctgtccataggggtgggatgtcagtaagctttgccggtgtctgtcccatagatagactcagctctgcattgcagccccaaaaggagcctgcattcttaaaagaattttaggggaagaaagatttaagagagcacctgaagtcctgaatcccttcagaaggaattcatggctgcctgtagtcagctgccagtccaaccttgccctccaaaagaagtcacagagattgagttttcagcgaggcagggagaagttgtcacatttgcctaattcttgtagaggtgagagtgggagtaaactggaagggggcggattattggtgatttgggggccacgtttccttgtatcacctgtaaagttttttttttgtttttgttttttttttttttttttggagacagggtcttactctgtcatgcaggctggagtgcagcggcacaatcacggctaattgcggcctcaacctccccagactcccaagtagctgggactataggcatgcaccactgcacttggcgtatttatttatttatttattattttttcgaagagacagggtctccttatgttgcccaggctgttctcaaactcctgaagcaatccgcccacctcagcctcccaaagtgctgggattacaggtgtgagccaccatgcctggctcacccataaaattaaaatgaaaagagcagaccacagccagcagtcttccgacctccagctcttgcaggtcgtgggcagccttgccccaggtgcagcaggtaggccaggaagcaggtgtgggaacagagcaacagcaggcaccgtggggacatgcacagtaagcgtcgaatcggtgtgcgtttgcagaaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacagaaatttttaaaaagtagctgggcatggtggcatgcacctgtcgtgtcagctacttgaaaggctgaggtggaaggattgcttgagcccaggagttcaagcccgcagtgagctatgatcgtgccactgtactccagcctgagtgaagggcgagatgttgtctcttaaaaaaaaaaaataataataataaaataaagaaaagaaaaaagtagaggttctgtgcttagttagaagatatctaacaacacaattggttagactttcataattatttctgctgatgtaagtatcacagcgcaggtcatgggcaacagtttactgttttcacacccagcttcaatgttaaatgaaccccagactatagcgtgaccagtctgatattatcatccccaaatctttatagtttcagctcttgggatggatgactgaataaccattttttttccagtgtggtagtcttagggttttgcttattggtgtgtgtgtttcaagaggaacctctgttccttggacttgatgtgagtggcaagtcatgtaaaaagctggattttatcaatagtttttgtctaaaaaccaaaaccaaaaaattcttcccctgcagtaccagtgcttgaaataaaccaccctcctacccccacccagcttgcctgcgtggatccagtagcacccccggtaccccggtgggcctttttggcagccccgaggggtcagggatctagggggaagagtcaccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatcaccaaggctgcctggtccaagttgcttcctgttgctgcatgggcagtgttctggggtccagaccctgggtggtagtgataagatggtgatggggtggagtgggtccttatagatcccacattactgagcggccttttgcccttcaaaccagatcacaatcccctccctgccagttggtcctcaagaaatcacaggaggctgggcgcagtggctcacgcctgtaatcccagcactttgggaggccaaagcaggtggatcacttgaggtcaggagttcgagaccagcctggtcaacatggcaaaacccggtctctactaaaaatacaaaaaaaattagccaggtgtggtggtgcactcttgtgatcccagctactcgggaggctgagacaggagaatctcttgaacccaggaggcagaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgtgaacttggagagtgtggggagctgccccagccgagggcactggatgggaattcatgccagaaccccatcacatagcggcaggagctgtaattgtgcttcttaattgtgtatcttcatttagtgcgagtttaggtggttagcaatagctctttagctagctttacagagtctaagttaaagagcccctcagctatcttgtagaaagcgccctggacaggatggggtgatgctgacagctggagtcactgttccagcgcccagaatggggagactagcagcacttctgggcagcccatgaagcagcctcttccctctgccggtgtccctcatgtccagcagagctagaagtgaaactcactgaggattgacgcggcccctttaaaatcgcatctccgctcttggcaccaggagctgtcatgtagtgtaacctgttggtgcccagaacccaggtttcctggtggcagccagcggtaccggtgccaggaggcagcgaaggaatcacttgcgacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaaaagccaaacctgacagtttcaaaatgaagttattagcacttcacctataactgtgatagcttttaacttgcaggatccttctcttaggcaccacctcccatccgaaccccagagcatatgggaaaaggagctaatgtgtgtaagttgcaggatacttaatcactgaagaatctaacaatgataactactatctctctggaacttttttttaacttagaagagtatgtcttgttctgtttatatatcacatagttttccaacgaccctgggaggtgaggtaggtggtatattttaccaatgggaaaatcgatgctcaggaagtcttggtgacttgctcaagttcccataacaagaagctgctgaatccaggatggaacctggtctaccccaaatgcccctactgcttcctagggcccagtaatgcccctgggtagggcgggcccagctctggaagaaacagggctatacaaaaaatcacccaatattgggtcaccagccttcttctacttgcaaaataattaagcaaaatctgtttttatttgtttttgagacggagtcttgctttgtcgcccaggttagagtgcagtggtgtgaacttggttcactgcaacctccgcccctagggttctagcgattctcctgcctcagcctcccgagtaactgggattacagacttgcaccaccacgcccggctatttttttgtatttttaatagagacagggttttgccatgttggccaggctggtctcgaactcctgacctcaggtgatccacctgcctcggcctcccaaagtgcgggggttacaggtgtgagccactgtgcctggccacaaaatctattttaattctgcaagttataagcagccagtggcccaccaggcccagctgtacgttcccagggaccccccaaagcgtatatgtcccgggcacacacacactaggtggtttgttttgttccccagcagcccgtgtctgcccgggcagatgttagtggctgagaaaccccaacagggagtgagccacaggcccgcgggtggcttccctgccagtgttctcctcgcgaaggggaagggagcccttgccagaatggctggtgccctaacaaattgattcctgccaaacaatagaaataaatattttcagcagacagaaatgttggctctgaaagcattcaaattaaaggcttatttctgaaacaaatactttaggaggaaaacatttttaccagcgcagatgagatcagagctattccttttggcagtggcaggactattttgagactcagccacaacggtttccctgccccgtctcgtttttcactgatgacctcgccccctgtttcatggagacagggaattgcattcagctagaggcatggggaagagatggtggcatggtgttctgcagagagcctcagttggacagtcggccgaatctggattcaaatccaggccctacctctcctgctatgatttcgacaaagccggtcagtcatctgatcatcagcttcctcagtctgtgaaatggggcggtacctcccttgcaatggttaatagcgttatcctcaggacctgggggtcattggaggccagcactgtccctagaactctctgtgttgattaaatggtctctacccgccccagcaaatataattgccactagctacatgtaactgttgggcccttgaagtatggcagctggaatggagggaacaaattttaaatttaacttagatgaaatgtaatccacatgtggccactggctaccattttggatagtgcagttcccattcatccctctcatttcattagttggtccctggagccaattaattggttggagggtcaacccactacaaatctcccaagtctttctctgtgccggatgcagctgtgcggagttgggacctgtctgttgtctttgacatccgtcttctgtcctgcagacggagcagtggggcagtgccatcgagctgggcagaggaattaatatcttagccatcaactgcccaaatcaaccttcatgggcatcttttaattttctaagagatggggtcttgctgtgttgtccaggcaggactcgtgggctctttccgcctcagcctcccgagtagctgggactacagttgtgcaccaccacacccctctgatatttcttaattttaatggctgatgtttcttaattttaacaagttcccatatgtctcatgatgtatgctaagtataaaaagaataatagaaggcatgaagtcaaggggcctgtttcccgggcatttgtttcagtggtgagtcacattcatgcgaagcctcggtttccttatctgtaagaccagatcagcaaaccacctgtggctgcctctctccctggttgaccccgaggccaagaggaggggcagggtcagcagccggccagacctcagtagcccctccccatcctggtatgggggaacacaggaggtagaaaacaagtgacctacacaaggcgggtggtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaacacagtgagaccctgtctccaaaaaaataaaatttgtatgtttatatactgagaaattttgtctccgcctctgtccctttttacccctactgtctaccctaagtcagtactgtacttctgttcattttctgggggtgtgctgaacagattcaagagaatagcatttccatggaaaggccgcagcttgtaagtttcacttgaatttccgtgattgggagttaatatcaaatgatctctcagaatcaagaaatactgatacatatcaaatgtataataacattttgagaattttttttttttttttttcagacagagtctcactctgttgcccaggctggagtgtagtggtgtgatcttggctcactgcaacctctgcctcccgggttcaagcgattctcctgcctcagcctcccaagtagctgagattgcaggcgcccaccaccacacccagctaatttttgtatttttagtagagatggggtttcaccatgttggccaggctggtctcaaagtcctgacctcaggtgatccccctgccttgccctcccaaagtgctgggattacaggcgtgagccactgcgcctggccccattttgagaattaaaggaacatgggcacgtaatctttatacgaggtggagtcagattgaatagcaagaggaagagaaactgacatccacgctcattgcactgggcgttttatgtgacttaatcctcatagcagctctatgaagtatgtatcagagggtgtccccattttacattaaatcacttgcctggatcactcagctggggagggtgagagccaggtgacctacccaaggctgtgtctctgggtggggggctcagaacctctctccctcgttttgtagtagccagacattgtctcgtataaactatggcaactggaagtgaaccaggtcttttcctgccctctgattttggtggaaaatgtgacctacccaggaaaagcactatgattttaggagtttaggtgcacaaagctgttttccaagcatgctcattcttctcccaatttgggactcattgctgcctctctgccctcatctgtggggccaagggagctggagcgacagccacagcagaccgctctgcatccctgtatgcgttgtgggaaacagcagaggaggtggcgttgcgcccatcttacagactccagattctgttcacccgacaggcagtgggaatccgtgttcacgctggtcccttggatcagaaattcagtacccttccctccacaccatgctgtagacacctctttcctctcctagacccggaacatcctctcttcttcagggtactggggaccaagatccaccctcgtggtgagaaaaccacaccataaataaacacagccaccatacgccgtgagatctggccaagaggtttccttctgttcattcggccctaatctccaagatgggaaggcattgccagctgccctgtgtagagattcctgaacacgcagtgtttcttattaacccgccagataaccagaaaatcagtctttgggcaagcgcttgcttctccacgtgcccagtattttctttctttctttttatttttttaatgagacagggtcttgctctgtcgcccaggctgggctcgaacttctggcctgaagtgatcctcccacctcagcctcccaaatagctgggactacaggtgtgcgccaccatgcccagctaacttttttttttttttctggagagacagggtgttactatgtggcccaagctggtctcaaagtactgggctcaagtgatccccccacctcggccttccaaagtgttgggattacaggtgtgagccactgtggccagctattctttaatttactagcgctgactacatgcctgtgatgtccccaggaccctgcaaagttctgggaaattcatagtgagcaaaacacagtccttgctggagttcacagcccatggggagacggcaccaaccctgtgcccagactaggggagctgccacgcagccactcactgagctgggcacacaggttcccatctcttatgaggtgaggcaggaggagcagggagggagctggggaagtggcatcagaacattttttggaagagagaaaggaaaggtttccaagcagaaggaacagcctgtggcgaggtccgaggggaaaggaggggaccctgttctctggggacactaggggaacgtcagcatgccaggtcagggttctggggagccctgggtggtcttatcgatggcccccaggaagccacagaaggcatttgagcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgtatctccagctttcctgctttcaactatgctttttgtctccttttcctcattgcgagcctaggcctgtatggggtggtggagtgggtgggagctcactgcttaggtgggtgggcagtgtgggtggtggtggttccatgggtctctccctcccactgtcccatctttgccactcatctgctgccccccactcccggaccccttttggaggtcagtctcactctgtggaaaccctggcttcctggttcgagatgccccctctggcccacgtgtctgacatcacgtaccagaacactgtggccatcattcaggattttttatgacacagtagtgaatcaaagcctgtcagtgggaaagtgatggggaaggattaagtgtctgagaacatttgggaaatatgaggttagacctggttctcaaacttatgaaataagtgaaaacatgaacgttcactttgggaattctgcaagattctcctttaaatggagtccatgaagagaacaaaatgaattttctgcagcgttacgcaggagcacttttctggaaatgaggtttcctaggactttgtcagcccttcaaagcctaggtctccttactagaggggaagaaatgagattttatttatttttatttttattttttattttttgagaccagagtctcactctgtttcccaggctggagtgcaatggcacaatctcggctcattgcaacctccgcccccagggttcaagcgattctcatgtctcagcctcccgaatagctgggattacaggtgtacgtcaccacacccggctaatttttgtatttttagtagagacagggtttcaccatgttggcctggctggtttcgaacttctgacctcaggtgatccacctgctccagcctcccaaagttctgggattacaggtgtgagtcacccactggccacaaacttatgaaataagcaaaaacatgaactttaactttaggaatctacaaggttctcctttaaatggagcccacgaagagaacaaatgaactttctgcaaatgagatgtcctaagaccttgtcagcccttcaaagcctaggtctcattactggaggggaaaaaataagattttaaaatatcaatgtttagccagactcagtggcttacccctgtaaccccagcactttgaggaggctgaggtgggaggatcgcctgagcccaggaattcgagaccagccaggacaacatagcaagacttccatctattaaagaaaaaaaaaaccatcgtttacttttaggagtaggcattacatttacgtgcttaaaataccaaaggtacccaagtgtagatatgaaagactttcccacccccaagtgagtgcccagccccttaatttccctccctggtatggatactaccagtatcttatgtttgtagaaccttctacagaaccttgtgtaggtagaagcagattctatgcatctatgtgtatctgtgtatttgcagtgactagattgattgctgttgatggacatattctggggaggtgtttttacacttccattactgagcacaggctcacaggatggcactttcccgcatgcaccaccatgcctggctgatttttgtatttttagtagagacagggtttcgccatattggccaggctggtctggaactcctgacctcaggtgatttgctcgcctcggcctcccaaagtgctgggattacgggcgtgaaccactgcgcccagcctgttttttgtttgtttgtttgtttgtttgtttgtttgtttttgaatagagacagagtttcactgtgttggccaggctggttttgaactcctgacctcaggtgatccacccacctcagccttccaaagtgctgggattacaggtgtgagccaccatgcctggcctcaatttctcccttttctaagccccccacctctgtttttgtcccatggtctggtcctgtcggccttgttgcacctggcagtcagggttgacttatgatttacttgaaccatccctggagcccctggcctggtgggggatgctggtggcagaatgaattcgggtctgaggtcaagcatgtgtctgtgagagtacacaaaatgaactgtgatgtagcgtttactgtgccacaaacttgaaatgcatcatcttgattatgtccagagaaaggaagtcatttgaccacagccacacaggttacaatggggatgcggcctggagtccaggtgtgagctaccacacccagcccacatacactttaaagatgagcaaatccaggctgtaatcccagcacttagggaggctgaggtgggaggatcacttgaggccaggagtccagtcaggtttgggaggccgagacaagaggatcgcttgagcccaggagtccagtttaggtttggtaggctgaggcgggaggatcgcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggtgggaaaattgcttgaggccaggactccagtttagacaccactgtttgaagcgtcttgggatgttttcagtaggggacttggagaagtgatggaaagaggctggtgggtggggcttaggcccaccacccctttctagccagagaaccctccattcatcgaaatgattctgttgttggaaatgaaacaaaaaataaaatggtcttaggaccttcctgtgcaggaaccatggccgacctttccctttttgtacaagtgatctatttttttcactagcaaaaccatttaagatttctatataggatgtgctgtttgattagtttgacagataatcccccaagaaacatcagatgaactcactctttggattaaagtttgagataataaaacaagaatacttgtgttgctgatgtggccagcccaagtatgtttttcccaccagcccagaggttctgggggcaggaggcatcctttgcaggcctagaaggacccaccctgtgggagcctggccctgtgcatctgcagagagcacttgctggaaatctcagtgggaaatggtggggatgcctcccatacccccactttaaaacaaacaactgacaattacacttttttttttgagacagagtctcgctctgctgcccaggctgaagtgcggtggcaccatctcagctcactgcaacctccgcctcccgagttcaagcgattctcctgcctcagcctctcaagtagctgggattacagatgcacaccaccatgcccagctaattttttgtatttttagtagagatggggtttcaccatgatggccaagctggtttcgaactcctgacaattatactttttgagacagggtctccctctgtcacccaggctggagcacagtggcttgattatgactcactgcagccttgacctcctgggctcaaacgatcctcccgccttagccccccaagtagctggaaccacaggcacccaccaccgtgtccagctaatttttgtattttttgtagagatggggttttgccatgttggcaggctggtctcaaactcctgggctcaagcgatctgcctgcctagacctcccaaagtgctagaattacaggcatcatccactgttcccggcccacatacactttaaaggtgaacaaatccaagccaggcatggtggcttatgcctgtaattccgcactttggcaggccaaggcgggcagatcgcttgaggccaggagttcaagactagtctggccaacaaggcgaaaccccctctctactaaaaacataaaaattagctgggcatagtggctcatgcctgtaatcccagcttctcaggaggctgggtcttgaaccctggaggtgaaggttaaccagtgagccgagatcacaccagcgcaccccagcctgggcgaccgagcaagactgtctcaaaaaaaaaaaaaaaagatgggcaaatccaaatggatctctggtgttatttaaatacttatttgggaaaaaaattttcccactatttctgttaagcagacagctggttacatggtagttttttaattttgtttttaataacatctgaaatgcctggcagaaagtctggagttgggggcagagagaaacttaaaatgttaggagctttgccctttgaggagctgtcagaattggagaaaaaacatcccagaaattgtaatcagtgaggaaaacaggattccagctatccacagcaccccagctgtacaccagcgtcacgggatgagggatgcctgtgtgcacgtaggccttggtttctgagctgagacagcagcagccaggccgacttggtgataggcttggcctgcccctgcagtggactgcctgggcctgggcctgggccttggccttggtctcagccctgtggtggatgatctgagccttggctttggccctccagtggatggcctgagccttggccttggccttggtcctgccgtggatgacctgagccttggtcttggccttggtcctgcggtggacgacctgagccctggccttggccttggccctccagtggatgacctgaaccttggccttggccttggccttggccctgccgtggatgacctgagccttggtcttggccttggtcctgcagtagacaacctgagccttggcaattggccttggccctccagtggatgacctgagccgtggccttggccttggttctgctgtggacgacctgagccttggccttgaccttggccctccagtggatgacctgagccttggcgttgaccttggcccgccagtggatgacctgagccttggcgttgaccttggcccgccagtggatgacctgagccttggccttgacctctgaagctcttctgtgcaagggtggggctcctgttggtgacacccacttgctgagtctacacctgggaagctcttggtcagctcggcccattgacttgagagaggaatagttgccgtccagcgagtgctgggggtgtaaggtggaccgggccacacggctgccaaggggccggctgggtgggactgaaacctgacccatgtgggtcctcattgcctcctgacatcagtcatcctgtgatctcttagaaagataaaaacacattttctgcgttctggtgcctctccttgccagacattttctcagtaaagtttctgtctcagcctcgttggaagtgccaggttctgagcccatcagtttgctgctagcctgccagcttcccatgacctgggacctgggaccaggggcccgcaggtgtttctagctggagaggagttctagatagttctgagcggataccctcctctgtcttcctcgggagagttctggcttggtttggtggtgttttctgtgaccagcagtggccaccgccaccaccaacccctcttccccctcccctcttcctccccctcccccctccctcctcctcctctatctccatacgccctgagactggccagtgggcagcatattgtgcaagaaacagctgttgttttgacaaaggacataactcgcctcacttcttgcatcaccagacccacgaggctctggattccaggcctctgcccctgcaggtggacacacagaccgtaacgcagaggctcacgtgtcccacactatgcattaccatttgtgtacgcactcgttcacatttagcaggattgtaaaaattaatagttagtgcagttcttccagctagataatgcatccaaatggcaagacagtccaaagatacacactatggagtaagtccctctccccaccggcccctctggagagagccaggcacggtcacaagtttcttctgtatccctctggagataatcacagcctatgcgagcatatggatggatattcttttaaacattgtgttgcggtttgctttttggcttggatgtatctgatgattatcatatcccttacaatacaccgtgtttttttacattacaggaaaatctgtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaaggtgggttcaccttgcaccgggccacctgtttcagtttcctcctccaccaggcaggctctctgacagatcagcccagggaggggcaggtggggaccgagggggacggagggggcccacagacccccggctcatctggcatcttccccagcgtttcccacacttgacccactagatgagaagttgggggtcggggctgggaccccaccttcatacctccagcgcctgccaactcaaagacatcggtagatgcccaccgattgggtaaccgcccccagcacccccaccctgctaggcttccatgcagtgggggaagtagggacccccggccaaaagcagtcatgttctttttgtttttctcctaagttttctgcgtctgtgtgcgattggaacgaaacatcaactctttttttttcttttttgtcatatttcaatattggctttcttccccgccttctttcgaaggctccttttataacttcggctgctgctgcttaaatatagatgtcaaagccctcctccctccagattgtttatatttttgaagagccttctgcttcgctgtgactgctcctctcttatctgtatcccccgttccaccacattggtttcggttgctcttttttttttttccctgccttcccttaactgggatgtgtttcaaatgtggtctatcaaaatgttcagtgtttcccttttttctgcaatagctttgacatctgttcttgaattctagcccacgttattccttaggacttgtttgcccaagatgtgcctgaatgccagaaatactaaggggagaagagtgtggtgtggtggtatcttcccctcattgcctggtttgttgttttattgtcgttgttgtttttttttctttcctcccctgctttttaaagtgtctacgattccttccttcttccttccttccttccttccctccctccctccctccctccctctttccctccctccctccctctttccctccctccctccgtccttccctccctccgtccttccctccttccttccttccttcccttcttccttccttccttcctttcttctttctttcttttttcccttgggacacctcactcatgcccaggctggagtgcagtggcgtgatctcggctcactgcaacctctgcctccccggttcaagcgattctcttgcctcagcctcctgagtagctgggattacaggagcccaccaccatgcctggctaatttttgtatttttagtacagacagggtttctccatgttggccaggctggtctcaaactcctgacctcgggtgatccacccacctcggcctcccaaagtgctgggattacaggcgtgagccacctcgcccggcctgtccatgatttgtaagttgacagcatgatttcatcccatccggcatggcccaccccgtagtagtaccaaggaagcatttcccagcaagaacttgtaacgtgtaggtttgctggttaacttccgccaaggaggaaagcctgtgggacttggtgagctgggtggtggggggtggagaaggagaggctctagtgtgcttcttggaggcgtggggataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagctcttcccagaatttctgaggccagggcacaggttctctggcgcgttgattatcggtttgttgcggggagcagagcccagagtcctcagccccctagcgggtccctcatggggaacccactcctggtggtcctcagcgttcccgcgcaagtaatgtgatttgagaataactgccaatggtgcctcatttctgaaaagtggttggaaataattattcttggaatttaccttttaaaggtccctcttgaaaactaatcataggttaatggtctcgaacatgatgcttggcctagagtgagctcaccataaacatttgttgaatgaatacaaaccaagtattactctcagagatcccaggcccacagcattgaaggacggccacacggaatgccccgaggaggggatagatcagcagaaggactagagctcaggagagtggctggctggaaggaacccttgggaagaagaggcgtggagcaacttggggaggcgggtgctttgggcattagcctgatagttgtggctggagcaagaaagatgtttctgtgtattctgttatgggaacagagtcatttatggcgtgcacattgaggcacgacccatgatgttgaacgagcttggttttctcaaccacttcacatgggacggacgtgggatggggggataatgttcatttctctgccttcccgccaccctccagcccctcctctgccaatgagttgatgttccttagagccactggggtctctcccccagtgttctggtcaaatgcaaataggaccctcctctagtacacagtgcaattacaatctcacttttcctttcctgtttccccaacagagagaactcgatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccatataagacataggaacatgcctggaggcaaagctcctttctaggagagatgcccctctcttacttacataatattgctgggaaattatatgtgaattgcatttttaaaagcggactcatttaaaatgtttcaaaagaggcttgctagtcaagggactgctggcatgaatcattatggaaaacaaattaataaccttctgtcttcagaataaatattttaggagaaagcttggtagcagagtagaaagaaggcagcctttggccacagagccagctaagggttcaaatctcacacccgctgcttgcctcggctgcccctaaatgtgggtactccatgtttcacgagaccaaaaatgcaggtgggagtcactggtgcttgggggtttctgccttctctgccagtgttggggagtggggggccctattctccatgtcagccttgccatgagtaaaaacaggaggaaaaaaagagctggggacagaacgtccttcttctgttgcctccagcggcttcagagcagactttcctggaactccggtttcctgagcgcttgtccttgactcagtttccccagcccaagccccgccacatccatcgtgctagctcctcttagtgccgttcctgtagctagtggtcacccaccgttctgtattgtcactgccctttcctcggtgaccatatgtctgagggtttccatagaaaatcttagaggtttggctgggcgcagtggctcacgcctataatttcaacactttggaaggctgaggcaagcaatcacttgaggtcaggagttcaagaccagcctgggcaacataacaagactcatctctgttataaaaggtaaaaagaaaaaagaaaacgttttgtggttaaaaacaaacaaagaaacaaaaaaacccagaaaatcttagaggggcaaggccatccttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagaggggagctggctgcaggctcctgccccgccagccctatgcactttctcatccaaggaccaacctggaaatctgtggggcgcccacgcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatatagtggcacaatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggctgcgcacaggcctgtccctagagtttagcttatgttcgttattagcattaacctgggaatactcaccgtgtaactcatgagatacagtggatttctgttcctcagagctagcttggggaatttctatgttttattttattttatttatttatttatttatttatttacttatttatgaggcggagtttcactcttgatacccaggctggactgcagtggcgccatctctgctcactgcaacctccacctcccaggttcaagtgattgtcttgccttagccttctgagtagctggaattacacgtacccgtcaccatgcccggctaattttttgtatttttagtagagacggagttccaccatgttggccaggctggtcttgaactcctgacttcaggtgatccacccgcctcggcctcccgaagtgccaagtggcatgagtcaccacacccggccttagctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtacagtggctcgatctcggctcactgaaacctctgcctcccaggctccagcaattctcctgcctcagcctcccaaatagctgggactacaggcatgtgccactgtgcccagataatttttttgtatttttcatagagatggggtttcaccatgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttataatcccagcactttgggaggctgaggcagatggattgcttttgctcaggagttggagaccagcctgggcaatatagtgagacctcacccctacagaaaaatagaaatattagctgggagtggtggtgcgtacctatggtcccagctactcagaaggctgaggtaggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagcctttaactagaaaaagtttaaaaattaaaagtgaacttttaactgttaccaattaaaccctttaagccagtttatcaacccaagacattattttctttcttttgggtctctaggggagaagaggtgccttgagtgggaccagtaatgaaggcaatttgaacctaattcgggccccagtcagggaaggtggctgcattatccccctacatcccagcaagactttgccgcatggtctggagggcaccagcaggggcctgtagggaagaggaggttgcctgggcccagggacattgaatgctagtcaagccctggtttcatttgctccaacagcattaatagtattgtgacctccatggcactgtgacagaaacttaaccccagtttcttcgtctgcaaaaaacataccctgcctacttcaaggggtcctggaggctgaatgtccagtctcaggccaggagtagaacgcataactagtaagtggtgacgtgcagtgaccttgagcaaggtcaaaaactgttctaagacttggtccccttatgtataagcaggaagaattggtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctctgttccttgtcactggaagtggtcagagctgttgcggggcttggcccaggggcggcgggtggcatctgaagaccccgcaggccctgctttccttccgggagcatctcaggacggccgctttgtctgtctgcccccgccccttgctgaaacgtcaacaaggccggcatcccctttccttcctgagagccatgtgtcgcttccttcatgtgtccagccgtttttacagggctattttaagtataaaagacgcattatctgagagtttaataactgtcaaaagggaagcactgtcattagattcatgtgccctggaattttagtcaaaaacatgctgcgttctatcacgtctaagcctctattttcttatctcaaaaaataggaatgataacgacctcggagtcattatgggctggatgaactcttatagggattcagaacaacccaggcaccaagtagaaggtcaataaatggcttattgtgttcatgttaccaaaatctactcttttgagaaattgtgttcacaaatggccttttttttttcttttttctttttttttttttgagatggagtctccctctgtcacccaggctggagtgcagtggcgcgatcttggctcactgcaacctctgcctcccaggttcaagtgattctcctgcctcaacctcccaagtagctgggactacaggcacctgccaccacgcctggctaatttttgtatttttagatggggtttcactatgttggccaggttggtctcaaattcctgaccttgtgatctgcccgcctcggcctcccaaagtgctgggattctaggtgtgagccaccacacccggcctcacaaatggactttttttttttttgagacggagtctcgctctgtcacccaggctggagtgcaggggcgcgatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgagattacaggcgtgagccactgcacccggccacaaatggactttaaagttataaatgtgacggagggcagtggctcacacctagaatcccagcactttgggaggctgaggctggcggatcacttgagctcaggagtttgaggcaggagaatcgcttgaacccaggagatgggggttgcagtaagccaagatcgtgccactgcactccagcctaggctacagagtgagactccgtctcaaaataaataaaaataaaataaagctataaacgaacacttaaaaaaattattaaagcctagggtagaccctagtttctactgcggacttgaacagatacagtaaaattaaaacttgccttcttccatatgtgtctagagagtaattttctctccttttgcattagtttcactgttcatagagtggaaatgtttgctgctggactttcttttttgaagctattctttgagagtagcccataacttgtctttctggtcaataacctcaactgaaatgcattctgaatggagaacgtcattctgtgtaggatttaataataacttcagcacagaaaagcactctctgcctcttctcagcaaacaactttgttgagcatgattttaaaggtgtaacggctaaatgtgaaagccatatgatttggttgaaatcgtggtgagctgttattaatatttattgagtacttgctaggagtcaggcattatgctaagtgcatgaccatcatttctctgcccctggaagtcaccctgggagctaagtatcatcggtgccacttaatgaagcgtaagccacccacccacctaccaggattttcccgggcagacagactcctgggaatgaggccatataatcccctgaacaccctgcctccttagggttccagaagccaattttttttctttttttgagacagatttttgttcttgtcacccaggctggagtacagtggcctgatctcggctcactgcaacttctacctcccgggttcaagcgattctcctacctcagcctcccaagtagctgggattacaggcaccaaccaccatgcccggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttgccattggcctgtgaaagccttcttaacttacggaattgattataagccaaagcgtgggaaaatctccccttccactttgagattatgtcagtcaagaaaatgacaattggataccaagccatgctaactctgatacttgctgtcttcgttttcttctttctttggctagggggatggagcgcgtgtggtgtgggtgggactagtcactgagcatgttattgactaacattggcttttcattttaacttgcaaatgtgagtggcataaaagtgagtttacgaggagcatgactggcctgttatgcagagtcttgtaattttgtttgtggccctttattttaagaagatgttgtgttatatagttggtgtccttaaaggagtatataattggatctggaagcttagattgtgattctgacttggccacttaatgaatgcaagatctgagcaagccatgacctctctgttgttcagtctaagaaaggaggtgttggtgctgagcatggtggctcatgcctgtaatcccagcactttgggaggctgaggcggacgggtcacttgaggctgggagttcgagaccagcctggccaacatggcgaaaccccgtctctactaaaaatacaaaaattagccgggtgtggtggagtgcacctgtaatctcagctattcaggaggctgagacggagaatcacttgaacctgggaggcggagattgcagtgagccgagatcacgccactgcactccagcctggatttcagagcgagactccgaggttctgtgtggctgagagccacacattttgcaacaagagactcgtcccttttccataggtgtccttattcctattgatcttacctgtgggcccaagacttaggcacatccctttcttcttaaaaggcatcacctcctctgcctcttggagttttcctacccagaattcattcatgtgtgcagcaaatattcctggcagtcccattgtgtgtggaatggggtaaaccaggaagactgttgtgagggctcagtaacttcagggacacagccgtcgtagcttataatggcagctgatatttagtgagcacttactgcatatccagtactattctaaacactggaaaggcatttaactaacttaacactcacaggatccctacgaaacaggtacagtgtttatttctgtttcaaagagagggaaactgaggcccagagaggaggagtaacttgcctaggcccacaggtggcaaagctgcctgaaggttttttttgagacagagtctcactctgtcgcccaggctggagtgcaatggcacaatctcagctcactgcaacctctgccttccgggctcaagcgatcctcacttcagcctcccaagtagctggggctacaggcatgcaccatggtgtctgactgatttttgtatttgttgtagggaggggttctcactatgttacgcacgctggtctcaaactcctgggctcagtccctcccaaagtgctgggattataggtgtgagctaccgtacccctcaggaattcttattttttagatggaaattttaaattggcttttattggaatctcattaaatttgtagatttggagaggctttagaaggcattttcaagttttgattgattgttttagatttcattcataggtgaatttcattctctatattttacttgagggatccacggaaactacctacatggacttcacttactctggttcattgtgtgggatacaaaatcgtcaaaattgaaggattgatcattgtgtctggagccaggcataaaaataaacctcactctgttatcataggtggctgtgattaagatcgagggaaatgtcggccctgggcctcctaacattgacagtttccttcagaagattaagtgcggcttcatttttggcccgggccatcagtagcttaaagccattactgtctattggctgtttggtttgtctgaaatatggggccggcgtcagcctatttccctggggtcaggtgtgttcacataatcaaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggtgatagcttctgtttccttgaattaaaagctgcagacaagtatattttcatttattttgtttataaatcaacaacccacgaaaggtatttcatacgtatttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctgtcttttagccctaatttagaaaaacttgtagcgctttcctttgaaatgatgaaaaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagaggtgaaaacagcattgcccggggtgaggagcaggaggaggaagggtccacgtataggagtggatggaggggatctgtgagacagctgctgggacagatccgacttggagactgtcaggcctctgagcccaagctaagccatcatatcccctgtgacctgcacgtacacatccagatggccggttcctgcctttactgatgacattccaccacaaaagaagtgaaaatggcctgttcctgccttaactgatgacattatcttgtgaaattccttctcctggctcatcctggctcaaaagctcccctactgagcaccttgtgacccccactctgcccgccagagaacaaaccccttttgactgtaattttcctttacctacccaaatcctataaaacggccccacccctttctcccttcgctgactctcttttcagactcagcccacctgcacccaggtgaaataaacagctttattgctcacacaaagcctgtttggtggtcttttcacacggacgtgagtgaaagagactgccattcatgaatggacaaggcctggctccgtccacgctttcccagctctgtgtcctgccatcggacatgctggcacatctgctgtgggtgccctgcacttctccgggcactcctggcccagctggggaggttggcatggtatccaccattttgttctaaagtagtaaatgaaactcttgggagggcagcacccagcagatgtttggagctagagacagggctctggggatgtgtaggaacccggacctggtgtggcaatggtgtggggctgtcacgaggcgtgaggaggctggggtggtgttggggacagcacacgatgctggggctcaggccaagtgaagcttggacttcactctgtctgaggctttgccaagtgtcagagggtgcacacttgggagtcacatggccaggctcacatttccagccgaagttacactctacagcctggcagcagatggacgtttggggacagaggtggagccggaacagctgagacactgttttagaggactctgcgagaaacacgctcttaaaacaaggaagcggtggttatgtcttattcaacaacgatctgttgtggaccagctgtgtgccaggcagttgcaggccctgaggctgcagcagtgagcagaaggccaaggtccctgccctcgcggtgcttacattctagtggagacagatgttaaactacagggcaggaaaacactgtcaaggagatgcaggtggaggattctgactgtggaactggggcatagagacagtgggttttgaaagcacttggctgagaaggatgggaggagggaggagggaggagggcgggtacatctgtagatggaccaggttaaggtatggacttccccatcctgacaagggggagccccaagcttgttttcaggtgtgacgggggtggggagaaagagagcattccaagagaggcacgaacgtcatttccagagcgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggctaatcataaaaacctcctgggtgtgtgtgtatgcttgttaaaaatactgtccctgggccccaccctagacttagtgagacacagtcaccggggaagggcctggggacttgcatttagaaccagctcctggaatgcttactctgaggccagtttgggccccctcccatggcctccctctgtgtcccttcctccagatgctgattgaggatgtgtcccctgccgggactgtgtttgcatgtctctgtctctgtcacaaagtagatgcctggggagtgtgtgctgcgtggccccctgaagaccctgtaccgggatgtcagcaccccagcccccagctcctccccctgtgaaagacattagctcctggaggggctcaggtggtggaaatgaatcttagcatcaatgtttagacctaaaagccatctccaggtcatcatagcacatgacagagatagaggcagaacctggtggccataggattatttctgagcaaagatcgcccaagctttggcataggccagggttattcacatgtccgagtccctggaagtggggtgtgaggaggttgtggggggccttcagaatgagggaaaagggataaatcaaaatcaagtctttttttttttttttaattgagacagagtctcgctctgtctcccaggctgcagtgcagtagcacgatcttggcccattgcaacccctgcctcccaggttcaagcaattctcctgccttagcctcccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaagccaggagaagggtgaataattgaattacagatgacagtaaatatttggatctagctgcttatgaggccttaatgatatcagtcagtacaaaaggttgatatccatgttttttggtgtgtgtatttttttttttttttgagacagtctcactctgtcactcaggctggaatgcagtgacgtgatcacagctcactgcagcctcaacctcccaggttcaagcgatccttccatctcagtctgctgggtagctgggaccacaggcgtgtgccaccacacccagctaattttttgcagagacagggtctcgctatgttgcccaggttggtctctcaaactctggggctcaaatgatcttcctgtgtcagcctcccaaagtgctgtagttacaggcatgagccactgtgcctggccgatatccaccatgtttggagcctgtttttggttacatttcatcctcatctactggcctggagatattggtgtcaatcagttcttcactgggggaagagatttttttaaaaagtcagatttacactcagtaagattcacccttttcaggtgtccactttgatgaattttgacaaccacatatagtcatgtgccaccaccactattaagatagaggacaggctgggtgcagtggctcacacctgtaatcccagcactttgggaggccgaggttggcagatcacccgaggtcaggaattcgagaccagcctggccaacatggcaaaaccctgtctctactcaaaacacaaaaattagccgagcgtgatggctcatgccggtaatcccagcactttgggaggctgaggcgggcagatcacttgaggtcaggagtttgagaccaacctggccaacatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagtctggcttctttcacttagcgcagtggatttgcagttcaacagtgtggccgctgtcagtgccaagtagtattccattgtatggatgtaccacagcatggagggatttttaaggctggtcaggcagtgcttatgtcacaggtccaacatccagtcccctgggccatttaaagccaagcacagccccacacctaaccctcgtctgaacgatcttgtacagccactctgcagtttcacatcctgaatgtgagcagtctttttttaaagaaggaggttttgggccaggtgcagtggttcatgcctgtaatcccagtactttgggaggctgaggcgggtggatcgcttgagcccaggagtttgagactggcctgggcaacatagtgaaaccccacctctataaaaaaaatacgaaaattattggtggtggttgcctgtggtcccagctgcttgggaggctgaggcaggaggatcacttgagcctgggagtttgagaccagctggggcaacatagtgagacccctgtctataaaaaatacaaaaattggggctgagcgcggtagctcacactttgggaggccaaggtgggtggatcaggaggtcaggagttcaagaccagcctgaccgacatggtgaaaccccatctctactaaaaagacaaaaattagccaggcatggtagcgggaacctgtaatcccagctacttgagagcctgaggcagagaattgcttgaacccgggaggtggaggttgcagtgagccgagattgcaccgctgcactccagcctgggcaatagagcgagactccatctaaaaaaaaaaaaaaagccgggcatggtggtgtaagcctgtggtcccagctacttaggaggctgaggcaggaggattgcttgagcccgggaggttgagaatgaagtgagctctgattgcaccactgcactccagcctgggtgacggagggagaccctgtctcaggaaaaaaaaaaaaaagaggaggttttaatgttcgcaaagctggtcagtttccaatctggtgtcaccagtggaaaaaagatgtaagtgttgttggcaagagaagctcacccagagacacgctccatgaagtccctgacccccgctgggggtgcctgtgatggagggtaggctgtggtgcctgcgggcgcgcacaggtgagatggaaggaataaggggttattccttctgggtgcagctctgcctggaggccagagctgtcctcctcccttcgatctctgaattaaagacgctcttctagtattttcttatgttgatatatatgtgtatatatatatatgtgtgtgtgtgttttcttattgttctagttcttatattgtcatttaattcctttgtcctttagcttgcaagggaatgtgttttcttattagattgtaagctctggggaggtaagaccagcacttccaccctcccagatccttggttgggcacgttattgatcagtccacatctgttgcttggctgattgattaaatgctgtggtgcccgtgttcactgagggattccagacccctgtctagcccaaggatgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaaagtcagaaggaaaagggcagggagccgggcttccttgaggcaggtggctcttttaaagctggggcatgttgtcgccaatctgagcttgtttccatggacgcagccagccgggcagcctgttcccgtcaacctgagccctgatggagcctcggacctgacaggctgcctggggaactcactgggaggagggcgggttgggggagacccagaagccatgctggagtctctctctggcctactttttgccatagtttgaagggaaagttagtgaattgccaggatcaacctgcagtttccccaaaacttgcacaggagtggctttcatcgctgcatggggagacctcctttgcgggtctgcttagcggtagctggattgtctctgagggatacctggctttcctaactgttcctggagaatcttaaagacgaaaatggaagaaagggctcacatctttgttttgtgctgcaagcaaagtcttggaaaaatgaatgatgccaatggaatctatttcttgtaattaatttcctcaagctactggatctccttttcttgctgagattgtggtttggcagctgcagtttgatagccccattctgagactggatccctctcttccctcatctggtagttttcacgtcggggcattcctgaactccgtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctatttaaaaattaaaaaaaaaaaaaaaaaaagacaacttgagccgcacacaggttcttgccaaagcctctattagtgctgtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggctcacgcgggagacgcatgctcctccgtgactgtttgtggccagtgagccaccagttgacaccagcaatccagccttctgcccctctcacttcacagatgagggaagtggggatctgcctaaggtcacactttggtgcatttctcaaatcaaacccaggagccggaatttttctactgagctcctgctaagacaccctgggtcgtttcctccgggcagtccatgtcatctgctgtggcgtgtatgttcatgggtgattctgtttctgtttttaaaccctgtgcctcttggttggtgcttttcctcctggaggatgctgcagacctgcagcggtcacctcgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgctaagcctttcagatgagttccccgtggtcatcagaggtaggccttgctgtcttaattttacaaaagatgaaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttgtccattatttgggctccgtaaacttggcattatcacgacaattagttgttgagggttttctaaaatgatttgcaattacatctcttaagcggaaaactgtctgctctgatggagtgagaatccattccctctgtgccctagatccactttaggaattggcttttcataggggaacgtggtgcctcgggattttataataaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggcagagtgcttgctttttttttttttctttttcttcctttttttttctttgagacagagtctcactctgtcgcccaggctggaatgtagtggcacgatattggctcactgcaacctccacctcccgggttcaagtgattctcgtgcctcagcctctcaagtagctgggattataggtacacatcaccatgcccagctaatttttgtatttttagtagagatggagttttgccatgttgcccaggccagtctttgaactcctgacctcaggtaatccacccacctcagcctcccaaagtgctgggattacaggcatgagccaccacgcctagcgagtgcttgctttttctgctagacagtggtcctcaggcccaatccctgagagaggggcttctgagaggtgaaggaggcaggagttcttgcccctgactctcaggagctggtgtctcctgggcatcactcacggatgggctgattattgctcattaccccacaggatccgacagttccagtacaagctgcttctttgagacagagtctcaccctgtcgatcaggctggagtgcaatgctggcgcgatctcagctcactgtaacctccgcctcctgggtttaagcgttctcgtgcctcagcctcccgagtagctgggattacaggcacccgccaccacacccggctaatttttgtatttttagtagagacgaggtttcaccttgttggtcaggctggtcctgaactcctgatctcaggtgatccgcctgcctcagcctcccaaagtgttgggattacaggcgtgagccactgcgctcggcccagaagacttatattttatgatataagaaaattatatgaaattcccaaaaaaacccagaaaattatatgaaattcaaatttcattgcccatagtttgttgtttttttaaaaaaaaaattgtagtaaaatacacataacataaaatttaccattttagttattttgaaatctacagtttagtggaattaggtacattcagtgttgtgcaagccatcactgccatccatctccagaactttttcatcattccataactcacctccataaataaagttttattggcactcagccatactcatttgtttatctattgtctgtggctgcttttctgggctacagcagcagagttgagtagttgcaacagagaccatatggcctgcaaaacttaaaatatatttttttcttctttcttttctttttttatagagatgaggtctcactacgttggccaggctggtctcaaaaatcccagacctaagcagtcttcctgccttgcctcccaaagtgctgggattacaggcgtgagccatgtagaatatttactatctgaccctttccagtaaaacttggccaacccctgtcctggtgcacactctccttacttcttagttaccatagcaactgcctaactggtctcacttcctttggtttcattccctttctgtatatctgccccctggaggagtttttccaagatacaattctgattgattaacttcgctggttaaaatcttttagcaggctggtgcggtggctcaacttgtgatctcagaactttgggaggccaatgtgggcagatcacttgaggcctgaagttctagaccagcctgggcaacatagcaaaacaccatctctactaaaaatacaaaaaataagccgggtgtggtggcgcacgcctgtggtcccaaccacttgggaggctgaggtgggaggatttcttgagcctgggtggcagaggttgcagtgagccaagatcatgccaccgcactccagcctgggtgatagggtgagacactgtctcaaaaaaaaaaaaaattcctttagcagcatcctgtagactaatgccatgtctgggaacaccagtcccaggataactgcactagttattaaaggctctataaactcttgcagaaaagaaacctgctgaacatcgatcaacccagtacccttcaaaactcattgactgggcaagtctttttccttttttttttttctggagacagtctcgctctgttgcccaggctggagcgcagtggcatgatctcggctcactgcaagctccgcctccagggttcatgccattctcctgcctcagcctcctgagtagctgggactacaggcgtccgccaccacaccctggctaatttttttttatttttagtagagacagggtttcaccgtgttagccaggatggtctcaatctcctgaccttgtgatccgcccgcatcggcctcccgaagtgctgggattacaggtatgggccactgcatttttcttatcacccattctcattagcctacagcagggattggcaaactgtttactgtaaagaaccagatggtaaaatactgtaggtttcggcagggccatatggtctgttacaaagactcaactctgctgtaaagtagccatagataatacaaaaatggtgggcgtggctgtatgccgataaaactttatctaaaaagacaatcaggcccatttgaactcctgtcctgtagagcagtggctgtcaaggtgtggcccaggccagcagcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaaaaaaaatttttttaagtcagccaggcatggtggtgcacacctgtagtcccagctactcaggaggctgagacgggaggatcacctgagacacgagtttatgtgtctgagacgcctgagacaggagtttatgaccatcctgggcaacataacaagagcccatctctatgacaaaatgtgaaaattagccaggtacagtggtgcacacgtgtagccccagctacttgggaggctgaggttgggggatagcccaggagttcaaggctgcagtgagctatgatggtgccactgcactccagcctgggtgacagagtgagaccctgtctcaacaaaataaaattgtaacccaaagtaagggctcaataaatgttagccactgtgattattctattattcccgtcctcgttgtaaatatttgtgtggcttggtgcctagcgtcttttgtagctgtatgtattgccaaggagaatcccaaggaaaaaaagtagaaatatggttaaagctggctgggcacagtggctcatgcctataatcccagcactttgggaggccgaggcaggcagatcacttgagtgcaggagtttgagaccagccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatggtgagaccctgtctctactaaaaatgcaaaaatcaactgggcctggtggtgcacacctgtaatcccagctactcgagaggcaggagaattgcttgaaccctggtggcggaggttgcagtgagctgagatcatgccactgcactccagcgtgggtgacagagacagattcagtctcaaaaaaaaaaaaaatgcaggttcaaggaagggagaggatgatttgtgttccgctctgcgcctcctccctggtccattcccttctccctgttggaccattgctgtgacacaggtgatctgagcatcaagaaaaaggcatttcttgcttctcagtgatattagcaagcacctgctgcttgtattcactgtgctgagttctacccatttattctctcattcagtctttacatctccctgatgaggaggcataataatatcatgcccattttatagacttgagggaactgagcccaagccattcagccagagagtaaccgagctggagttccaccaggtctgtctgctctgatagcaggcatgcctgacctccgcacctacccacttccccacttctgcagtctcatgtgtcccagggaacgcacagctggggcccctctcctaatttgcacccttcctgagccagttcagaagtcccagactgtgtctttctggctggctgtgtcactgggcccaaggatggtgctacggggctaaagatcttctacactgaccctctccactaacgggaaatcagaaaagggaacttgaagagaacattggcaccaatggttggacctagggatttgtagccacctttctaagggagatagaggacagggctaagagtcacaacttttgttctctacccttgagcaatcgaatacttgcaaagccctgtttctaaggttaaaaaaaaaaggctgggccctgtggctcacgcctgtaatcctagcactttgggaggccaaggtgggcggatcacgaggtcaggggatgagaccatcctggctaacacggtgaaaccccgtctctactaaaaatacaaaaaattagccgggtgaggtggcacatgcctgtagtcccagctactcgggaggctgaggcaggagaatggcgtgaacccgggaggtggagcttgcagtgagcccacgtctcaaaaaaaaaaaaaaaaaaaaaaaaaggaggcagctttgggggacaaaacattcagcgtggccggctctccgcatcttacagtggtagggatgaaatgcacgcgccctcatttgaaatgagaatcgcagtgcctcagttaaacagcggcctctccggatgccaagctgagatcatttccatttctgtgccgagatcggccttttgcagagatagatgggttatatttatcaccagctaacttattagcatgtgacaccagatacaccaaattgtaatctgactcataaaaggatatgtagttcatgacttgatggtgaagcaggtcagtttaaaaaaaaaaatcagatggattatggagtcaacgtttccttcagaaaacttcttcaggggtaaactggtataataggaatgtctgttcagactgttttgaaaacagttaccttgagaattttgtattcctttgacccagcaatcccacttttgaaaatctatcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagtatgcgagccctttgctggaacatgtttctggaatacttgctgttattagtggaaatattgccaccgtgccatgtgccagactccgtgtgaagtgtgcagagtgctaggtgggtaaaaatagcccccctccttctagaacctccaacccaaaggtgggaaggggcacacaggtaacagaaatgacagcgttgacatctggtgtgtgctgtgtaagtcatgtcatctgtgctgaaccctggggctcaggagagacgtagtggggctgtcgtgggaactgggccctacttgggagccaggatgtgggcccggcctgaagctgcagcagcagcagcagcagcaagatgtgagaatatttaggagatggaacttggttcagtgggaggagtaacccaaaaggactctagggtggtcctgagattttcttttctttttttttttttttttttgaggcggagtctcactctgttgctcagacttgagtgcagtgacacagtctcagctcactgcaccctccacctcccaggttcaagtgattcttcttcctcggcccctcaagtagctgagattacaggtgcgcaccaccatgcctggctaattttgtattttcagtagagacggggtttcaccatgttggccaggctggtctcaaactcctgggcttaagcagtctgcccacttcagcctcccaaagtgctgggattacaggcatgagccactggccagtcctgaagttttcacagaagcatgaaaacacagagagaattccttttctgtcataaggagatgatgcccttttttttttttttttttttttttttttaagagacagtattgccctgtcgcccaagctggactccagtggtacagtcgtggctcactgcagcctcgacctccctggcttaagcaatcctcccacctcagccctcctaagtagctaggactacaggctcatgccagccaccatgtctggctaatttttaaattttttatagagacacggtctggcagtgttgcctaagctggtctcaaattcctgggcttaagtgatccgcccacttcggcctcccaaaggattacaggtgtgagcaaccacgcccagcctggatgattggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgagcaggcagatcacctgaggtcaggagttcgggactagcctggccaacatagtgaagccttgtctttactaaaaatataaaaatcaggcgtggtggcaggtgcctgtagtcccagctattccagaggctgaggcaggaagatggcttgaacccaggaggcggaggttgcatcgagccaagattgtgccactgcactccagtctgggcaacagagagagactccatctcaaaaaaaaaaaaaaaaaaattgcagagagtttgtagtacatgggtcaggcttaagcaaaaagaaagcaacttaggaagtatatatacagtattattacaactacaaaaggaacaggcagaaaaaaccctggaaggaaccatgccaaaatattaagtctcctttagggagcaggacttggagtcgtatttctttatgtttttctgtgctttaaacatactctgccatgacatattccttctgtgatcagaaaaatataaactaacagtaacagcagaacatcccttccccccaaatacaggtgggaattagatgtctgaagagctgaaaacacaaatgtatcgatttcatctttttaatatttccctgcaattcatcttgccttaatcaccgttttctctctgtccgtggaatcacagagctaactgcacagaaacggtgtgaatgaaaccaagttggccctacgtggaatctcaaatcgctctaccctttcgggatcttccgtttaagtttttggataatgaaaatttgatcttgatttcaactaaagctgttgtgtataaatctaacctttctatttagcgaaggtttttagcggtccatagaggccggagataacgaactgttacttgtcttctgtctttcccgtgtctgccatgggttctggtttgtaggcagatataaatgcagatacgtgtgcccctgtcgtgtctgaaaggatgatagaagcgagctgaagactccttcctgggagaaatggatttctcccttgcttttagaatcctcaactcctcccattcattctgagcaatagccatcataccatatttcatcaatctcagatttcttttttcttcctttttttgaaacagggtcttgctctgtcacccaggctggagttcagtggtgcaatcatagctcactgcagcctcaaactcctgggctcaagcaatcctcccacctcagcctcctgagtagctgggactgcaggtgtgcaccactgcaccaggccaatttttgtattttttgtagagacagggtcttgccatgttgcccaggctggactcaaactcctggcctcaagtgatcctcctcccaaagtgctgggattccaggcatgagccactgtgcccagcccaatctcagctttctggtttggccaagggatttactttcaagttgtaaagtaaacaacttgtgcttttctgcttttgccatctcctggttccccctgctgatgccacctctgatgccacttgtcacctttctctaaaccacccccttctctcacctggcaggaaaattccctgcctatccttcagtgaccccagcaccggtttcagtgccagaaaatgtgctgtcctccctgtatttggctcgcctgtcctccccctcactgatgttttctgctcattgggtgggggaggaatcacatgggttaggtgcccatccgtccactcctgtattccatgcgcgaccacggtggcccaaagttggattccagcatgtgatgttgaatgaggcaggcgtggctcccgtccccgggctgcacccagcagttcatcccggatccaggcctctgccttcctctactctcacctcttctcctctgcagagaagtgactgctgctggttagtagggtgggaagtggaggctggagggcatttgagagggcagagctgagttctggcctgatccagtcactcaacagcccatttcctcatctaaaaatagaataataatcaattacttagtacctgtcaacacaagcctatgtatatatatatatattttaagagaccaggtcttgctctgttgtccaggttggagtgcagtggcgtaatcatggctcactgcagcctcagctcttgggctcaagtgatcctcccacctcagcctcccgattatctgggactacaggtgtgtaccacgacatctggctaactttttaattttttatagagatgggatctcactatgttgcccaggctggttgcgaactccttacctcaagtgatcctcccacctcaccttcccaaagtgttgggattacaggcatgagccactgtgcctgggcaagccaatattttaacaggccctttacctatgtaatttcacttcaacttctcggcaaccctgtgaggtcgggagatcgggtgttcttgtcaaaggcacatcaagaaatgacaaggcggtaccgggcacagtggcttatgcctgtaatcccagtgctttgggaggccgaggcaggtggatcacctgaggttaggagttcgagaccagccttgccaacatggtgaaaccacgtctctactaaaaaatacaaaaattagcctggcgcagtggtgagcacctgtagtcccagcttctcaggaggctgaggcaggagaattgcttgaacctggggggcggaggttgcagtgagctgagatcatgacagtgcactccagcctgggcaacagagcgagactccatctcaaaaaaaaggtgaaagaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaaaaaattagcggggcgtggtggcaggcgcctgtagtcccagctactcgggaggctgaggcaggagaatggcgtgaacccgggaggcagagcttgcagtgagccgagatcgcaccactgcagtccagcctgggcaacagtgtgtgactccatctcaaaaaaaaaaaaaaaaaaaaaaaaaagatgacttggagattgaaagaggttgaagagatagctaaaggcaatgtgtggacctcatttagattacagttggaaacaagccagcagaaaacgtgtttctgaaacaactggagaaattagaacagtgggtttctggatattttatgatattgaggcgttattgctattatttgtgaagtgataatagtgtttgttttgttttgttttgggacagggtctcactctgttgcccaggctggagtgcagtggcaccatcagggctcactgcagcctcaacctccccgggctcagctgatcctcttgccccaacctcccaagtagctgggactacaggtgcgcgtcaccatgcctggctaatttttgtattttttgtagaggtggtgtttcagcatgtcacccaggccccggattatagtgttttgactgtcttttttttttttttttaaaggatccttatcttttagagaattcacactgagatatttctggatcaaatgacttgatatctgagatttgcaacaattaatacagtaaatgaaacaagcctggccgagagttgatactcattgaaagcgcatgatgggcacatggggactggtgttactgtttgcttgatgtgggcttgtctttgagattttcgtagtaaggtggtattttgcacaaaaccccagctctgatttttctgggaaagtgggaaggcctggtgattgcaggctgctggagctttagatgggtgggaatgtcctaggtggcggatgtcccatggtcatgtggagggaaggatagaaagagcatggcagggggccaggtgccccgacaggtgagggccacctgcagggaacatcagaggtgtgtgcttcttgagggtcgttacccacggtctgtatctccctatattcaccaaaatacacgtgggacttcccttctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgctgttcacaggtgctgttacttgggggaatcataatgctctagggtttttggtttggggatttttctttgtttttttgagacagggtctccctgtgttgcccgggctggaatgcagtagtgtgatcgtagctgcctgcagcctcaacctcctgggttcaagcagctccccctgcctcagcctcccaagtagctgggactataggtacacaccaccacaactggatatttgttaaaatttttgtacagaggaggtctccctgcattgcccaggctggtctccaattccgaggctcaagtgatattcccaccttggcctcccaaaatgccaggattacaggcatgaaccactgcacctggtactagggttgtatcgtttgtcttttaaaaaatcttcacataaaagttaattgtggggtgggagggagttcctatatcaaaagtatgttgaaatacaagagtcaagaggttgagtctggggtccaggtgggtcccctggacaaccctctgcagacttgctgctgcttttgttaaagtgtctgggagtcccaagccacatggggtaggggcatcagaagagtctagaattattatttttgagacgtggtctcgccctgttgcccaggctggagtgcagtggcgcgatcttggctcaccgcagcctccgtctcccaggttcaagtgattctcctgccttagcctcctgagtagctggggttacaggcgcgtaccaccgtgcctggctaatttttgtatttttagtagagacagaattttcccacgttggccaggctggtctcaaactcctggcctcaagtgatccacctattttggcctcccaaagtgctgggattataggcatgagccaccatgcccggcctgaagagcctagaattcttcagccttctccaggatatccctgctgcctgggtgggagacaggggagagttggtagggagaggactgtgctgtggaggtatgactctgcaaggtgaccccggctcagcagctgatcagctctgtggccttgggcaggacacggggctccctgaactcctctctccacattggtaaagggtctggtcaggccagctgtgggctagtggtgagagtaacagagatactgatctgttactggaaacgccatgagctgattgctgtcattaacctccctgtactgagagttaaacaaacaggcacctaggatgggtgcagtggctcacacttgtaaccccagcactttgggaggccaaagcaggaggatcacttgaggccaggagtttgagaccagcctgggcaacatggtgaaacctcatctctacaaaaaaaaaaaatgcaaaaaattagctgagcgtggtggcgcacacctgtactttcagctacccaggaggctgaggtgggaggattgcttgagcctgggagttccaggatgcattgagccaagatcgtgccactgcactccatcctgggtgacagagcaagaccctgtctcaaaaaacaaacaaacaaaaaacagcaaaaaaaaaaaaaaaaaaaaaaaagcaggcacccagattttcctgtactgtaaagagaaaaaccttgaatttggattaggaaggtctgaccctgtcacaaacaaaagtgaccaaatcatacattttgaaattcacctcctttgacaaagccaggatcctcatgaaagagaagattctgatgtgaagtcagccctgcactttcagcctttccagcgtgcaggttgatagaatcccacactttttagcggtcgaagggaacttaagatgtagcagttatttcagagttgtgaagcagagaccaaaatagtttgaagctgaattttaagcctcttttggccagatcaaagaaacccaaactcctaaaaataccaaattagctttttaagcatagtttctatctttagttgaaaatgtgtgcagtgtatacttctggaacctgcttaaatgtatccattgaaatgaagatgtaccttgaaaaaagaggcgcctgatctgcagtaataattaagtaactttctctgcccttgactcttgccccaacgcgtatcaggattccacggtcccctttctccttcctttttcaattctgaaaccatccttgtcttcttgccggagttagcaccaaaaaaaaaaaaaaaaaaaaaaaaaagttactcttgtagtttacatgtcataaatgaaaatggatattccctcccagggcataatctgaaatatttgtatttgggtttcaaatgtgtgataagatgctctctgtggcagatcggcctttctaattgctgtgcttgttaaaattcaaattaggctttattctcttagcaaacgttgactgacagttgcagagagtggcccagaatggcactgagtgatgggtggccaggaagcctgcggtaggaaattcacaacagacctttcatagagaaacggctggccttgactttgagtccttccatcccaggtgctttagagacagagccgcctgacccttccttagcttggcccgggggtgcgttggagggggctgttcccacctgcagttcctaaaggacaaactgtctgatacaggcttcatgtggggctggccaaaccccaccgaggtttgcacacaccccaggattgcagaacctgagctcgaggagtgggacatgacctccccacgcctctgctgagtatcccagaccttcccatgtctttcttttctttctttcttttttgaaaaggagtcccattcagtcgcccaggctggagtgcagtggtacgatcttggctcactgcaaccttggcctcccaggttcaggcattgctcctgcctcagcccctcgagtagctgggattacaggcgcgtacgaccatacccggctgatttttgtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgtctggatttgtgagttgggtgatttcagatactgatttatttttatttatttatttattttgagacagagtctcgctctttcgcccaggtgggactgcagtggcgctatcttggctcactgcaagctccgcctcccgggttcacgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaagagatcgatcagaattttcttgcctcctcggacggcatctgacctggctaggttgcggggatctgttggagagagaagcgtgtcatggatcccgcatcgaaaacagccttgaagagggccaggagcacggaggacctggggagggccctgaccactggacacatctgccctttgctcctcctttttgtctctgctggtggccctttctgctgtattcacgcgccctcaccacctcctgtgtattcgtgtgctggagttcagccgccaaggtggagagagactccctgtcggggaaggactccggccccaatgcctcctcctccaggccaggccgccatggtgggtgggaagagaggccactcctagagaaagagacactgtcagtaggtgtcaggaggtgtcccgggagctcgccgcgtggtaaccaacagacacagcccttcttggcattcaaagttgcaccctgatgcctgtgagggagtcgtgactttctgttaccactgacccagggcagagttttaaacagtgaccttaaggcgaaaagctccagatctcgttactgaccagtgcagccagccactgccttccttcctttttgattctaaaaatgacactcgggttttagagggttgcttttcaggcagccgaaatccccgcatgcaccttctcgtacatttcaggagagaagaatcaagtccatccacggtatccttgcccaggtaccggtatccatcagagcgtgattggggtttcagcagagccaggcctgcttttcctggcagaggctgggcccctttagatttttcttgtagattttgcttgagcctcccagcccttccttgctcagcacctgtgacccactgggtcacagtgacccacatcccatggctctgaccgcagctggactcatctcacactcacgttcatcacggctcccagaaggcacgtgtttttaatgagaggctcatttccaccactgccccccagccctccgcagcaagccagtgcaacgccaggacagtctgctgacaggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctatactgtccaccttgccccagattctttttctttttctttttcttttttttttttttttgagacggagtctcacactgtcgcctgggctggagtgcagtgtcatgatctcagctcacggcaacctccacctcccaggttcaagagattctcctacctcagcctcccgagtagctgggattacaggtgtccgccaccatgcctggctaattttttgtatttttagtagagacggggtttcactatgttggccaggctggtctggaactcctgacctcgtgatccactcgcctcagcctcccaaagtgttaggattacaggcgtgaaccactgcgcccggcccagattcttttttttttttttgagatagaatctggctctgtcacccaggctggagtgcggtggcacaatctcactgcaacgtccacctccctgggctcaagtaatgctctcacctcagcctcccaagtatcaaattctcattttaaaaattaagaatcagacccaaaaagaacaaatgacttgaccatgactgaggccacagagccgaaaatgtccccatcctggagtcttactgtggcacactctcatcttaaccacacactctagttttatcctctctgtgtctttcatagattatcaggaagcgaaataacctgttaatattttcaaaagttcttatgaaatgtgaagtgctgtataatgattaagatagaaaggagaaactaggaaacgagagcttttaatcctagcttacaggaaattctaactagtaggaaatctaattcaggcagcgctgggaaacatcacaggctatgagatgaaagtcagctaaattgggatctaattctataatctaaatatagatgtagatatattacaggttggccttttcagctggagagagtatcattcactccaaaagtgccttttgtatcacagagaagagcgcagccaggggtgatatcagctgaggaagggggcgggcagcttggcgtgaggggctttcattcattccttagtcatctctattttcttaaattttatagtaggaattatttgtgcgttgtatgtataataaacacatggaaaagacaagagcgaggaaggcatctcaggagtgtttttgggaaggaggctgtcatggcatgtgggcagagggaggtctgggaatgggatttgctgggtcagaaagatgtccatgttctttgccaatttggcatcagaaatggcccacaccagccaggtgtggtggctcatacctctaatcccagcactttgggaggccgaggtgggtggatcaactgaggtcaggggttcgagaccagcctggccaacatggcaaaacctcatcgtccccactaaaaatacaaaacttagccgggcgtgatgggaggtgcctgtaatctcagctgctcaggaggctgaggcaggagaatcccttgaacccgagagatggaggttgcagtgagtcgcgattgtgccactgtactccagcctgggcaacagagcaagactctgtctcaaaaggaaaaaaaaagagagagagagagagaaaagaaaaggctcacgcctgtaatctcagcactttgggaggctaaggcaggaggagcttgagaccagcctgggcaacatagtgagacctccttatctctacaaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcctgtgtaaattaccttttgacatcctttgtttattttggttggtcttttacctcgtcgtcatcttactcacttttaaagagcatgaattaaggccgggcacagctgctcacgcctgtaaccccagcactttgggaggccaaggtgggtggatcacctgaggtcaggagttccagaccagcctggccaacatggtgaaaccccgtctctactaaaattagccaggcgttgtgatggatgcctgtaatcccagctacttgggaggctgaggcagggagaatcacttgaacctgggaggtgaagattgcagtgagccgagatcacaccactgcactccaacctgggcacagagagagaccccatctctaaaacaaacaaaaaaccacagtatgaattaattatttctctcttacatgttgtagaaatttttcccaaatctaccattcattttgtaaacataaactatatttctgtactctcttatagtaattgtagatttctagtgtttcacttggtttttgaatcgacaacagttttgtgtgtagggtattgtagtgtaagggatctgttttttcccccaggcagatagctcattttcccaatgcaatattcctttaaatattctgaataaaagaaaattttaaaaatcatttttgagcgatgggaaatgtgaaccaaaaatatgcataaggaatttttgattgaaaaacccagacgggggcaggagtttgaaatgaacttcccctaaaagccaaaacttgtagaggtggcagcctgagggctttccagagagctgtaattgactgtttctcccatcagccactctcctctttctcataacttttttgggcagccattaaagatctgatgacgagtgtgaatgtggcagcattttggcattttggatggtggcataattgcacatattgaaaaactctaaatttacatcggtggatccagtgcgtctcattatactggaggtgtgaaaactccatgtgcctctttgaacaattgtcctgctctgtcacagttcaggggaaacaaaagtagctccaacttcccgagatttaaatttgactttattccatttagttgatattgtaactagaatttgaatagtcttttccctttctgattttttttttttttttttttttttttttggagatgtagtttcgttcttgttacccaggctggagtgtcgtggcatgatttcagcttgctgcaatctccacctcccaggttcaagcagttctcctgcctcagcctcccaagtagctgggattacaggtgtgtaccaccacacccggctaatttttgtatatttagtagagatggggcttcaccatgttggccaggctggtcttgaactcctgacctcaggtgatcctcccgcctcggcctcccaaagtgctaggattacaggcgtgagccactgcacccagcacccttcctgatttccatttccgcttttatctctccactcccgaagatgtatcaacccacaaggaacttccttccagcccttacttaaaacattgctctttttccagctccagatattccctacattggctgccactcctccttgtctctgttcagtcttggaaaattggtttggtccaagctgaagctattctttgaagaaataccattatttttaaataaaaggattccccagcctggacagtgtagcaagaccccatctctaccaaaaaatcaaaactttagccaggcatgatggtgcacacctgtagtcccagctatttgggagggtgatgcaagagaatggtttgagcccaagagatcgaggctgcaggttagctatgatcgtgccactgtactccagcctgggcaacagagtgaaaccgtggctcaaaataaataaataacataaaaagattctcctttgagagaatcgcttgaacccaggaggcagaggctgcagtgagtcgagattgcaccactgcactctagcctgggtgacagagtgagactctgctcaaaaaataataataataaataaataaaaaagattcctccttccaggagccaagaactaggaatttcaagctgcaatcttgctttttaagcatggttatatatggggggtcagcagaatgtgtgaaaattattgaaaagtaaagcatgagatgtgactgagctcttgagagcagaccactttccccttcttaaaacgttttttttttccctgacccctgtctgagatacaggctctcctggttcggcccaccttgcccatcactctgctgggtccccactcgcgccctgcacctgaggttagagggcacataagtctcggggacctgccctttgatatctacaagaccctgtcctcaggggatcccatcgactctcgtggcttaaaataccatccacagaaggatggcgtctatatttatattaacccaaatattcaactgaatattcaacatctctacttggaaagacatctccggcttcacatggcttcaaaagagaactgttgacccctcccacacacaccgcctgcaccaccaatcccagtccccctgtcacctcgggaaatggcgtcaccacccaggggctgctcaggctaaaacctaggtgtgccctggggctccccctcctctcccccgacatgcctggtccaccagcaagcccgtccttcctcctggatacacctgggctcccagctacacgctgtcaccttggcccaagccactgtcatggccaccccaccaccacttccgttcttggctgccttctgtccattctctttccccagcggcctcagttttatttctaacgaatgcagttcagatctttccgtctccctgctagaccctctgatgtctttccatccaaccttccacattctgtgaccccacgtcgccctcactggctgggccacggcccctctagccccggtcttcacccttgaacctgcctagcctctgtcctcctcctctgcgccccgtggcttcttccactttcttccacctggctcacccggaattccagctacttgtgctcttcctgtcacacattgcctggtgtgtcatttccatctctgtctacctttccctcctagaatgccattcccatgagagcactttcaggccacttcacggcgtacgtccagccccaggcacagagcccggggtatcataggtgcacagtaaacatctgttgatgggctggctggattctatgtgggaagcataatgaccagtggtcacaaattactggggccagaggggcgctgcctggtgttaaccgcctggtgcctgccctacctttaaagccaagagtgtccatttaatgagcaagaagcagaaatcctgggcaagcagtgcagatgtaggctctcgggaacatgttgaccactcagaaaaccttccaggaggtgagtaccaggagatggaggtgctctagactgtgatgctgggaaaggattgtgggctagaaaaagggctccctagggccggcatatgggccactgggtggaagaggggctctgagaccctcaccctggagcaggtcatcacccacaccgaaggaatgaagcgtgaattcggtcacgcttaaaatgttgaattgttggcaaaagcccaagttaatgaaatagcatggaaaatggatgtgatgagatttttgaattgtaattagattaacattgtcactagttatcagtctgatatatcttataaatcaaacgttgggttgatttatcttttatcacttctagggacttactcctaacagtaactcacaaaccagccccaaatcagagctggtaggatgggctcccagctatctttaggaggtttgttggtttggggaagacagctcccccttggcagggctcaggtgttttctttcttttttcttttttttttgagacggagtcttgctctgtcatccaggctggagtgtagtagcacaatgtcggttcactgcaacctccacctcctgagttcaagcaattctcatgcctcagcctcccgagtagctggcactacaggtgcccaccaccatgcccagctaatttttgtatttttaatagagatagggttttaccatgttaacaggccaggctggtcacgaactcctgaccttaggtgatccacccgccttggcctcccaaagtgctgggattacaggcgtgagccaccgtgtccggctgggtgttttatttcttcgtctgttattcaggaactttgtttccagcgctgtgagtatgagtacaggcccagggctgggtgacagagtgcggagagcggggccctacccttgagctgtttctggaagggctcccagccagcaccgggcttagggagcagtgccctgcagtgtcattctgggccagggaggttgtgatgaatattattctcaacagagggtccccagggcagtgatgccactactcaggatcttacagaagaagaaccttcaggctgggtgtgggggctcacacctggaatcccagcactttgggaggccaaagtgggaggattgcttgagcccaggagttcgagaccagcctgggcaacatagcaagaccctgtttctccaaaaaaaatgtttaaaaagtagctgagcatggtggcatgcacctgtggtcccagctactggggaagctgaggtgggaggattgctccacccgagaggtcgaggctgcagtcagctgtgattgtgtcactgcagtccagcctgggcgacagagggagaccctgtttccaattaaaacaataaaaatcttcattttgaagaatctgaccagttctctacctggcacttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccgagaaccagcccgccgtccgcacggatgtacctggaagccacagtgccccacaccccgtgggactttctcccgaacacagcacctgcgcttcctgactcctctctctgaatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctttttttttttttgagacggagtctcgctctgtcgcccaggctggagtacagcagtgcgatctcggctctgcaacctccgcctccctggttcaggcgattctcctgcctccgtctcctgagtagctgggattacaggcaagcaccaccacgcccagctaatgtttgtatttttagaagaaacggggtttcaccatgttggccaggctggttttgaactcttgacctcaagtgatctgccgccttggcctcccaaagtgctgggattacaggcgtgagccaccgcacctggccaggtttcaagtcttgactctaataaaaccagggaggtttcgctcagccacataagtgggagggaaaattaactgttgctttctgtattcaccaagatggcctaaaataagcaagcagaaaagggaagaaagaaaaccaaacccatgaggttgtccaagtcgatcttggcaggtattttcttgcctgttgattgctagagtttccctctacctgcattgcaggctgaaatgtatgactcagccctgaccaataacatagcagtaaaaagtagtttcccctgagagctttctcttcctccatagctgtgactgctgacatcttccactgtaagtgagaaaagttgagtgtgccctgctgcctcgtttttctcaccaaggtgttatgagctggtagggaaggccaggagctagggcagcagctttagaattagtgcaagagacaggaggacaagtcactgggtctcctgaatttcctcacctgcaaaacagggacagtttttaaatttcttttttttttctttttttcttttttgtttgagatggagtcttgctctgtcgcccaggctggagtactgtgttgtgatcttggcttactgcaacctctgcctcccaggcttaggtgattctcatgcctcagcctcctgagtagctgggattacagatgcgggccaccatgcccggctaatttttgtatttttagcagagatgaggtttcaccatgttggttaggctggtcttgaactcctggcctgaaacgatctgcctgcctcggcctctcaaagtgctgggattacaggtgtgagccaacagggacttttttttttttattatactttaagttctaggatacatgtgcacaacgtgcaggtttgttacatatgtatatatgtaccatgttggtgtgctgcacccattaactcgtcatttacattaggtatatctcctaatgctatccctcccccctccccccaccccatgacaagccccggtgtgtgatgttctccttccccaacagggacagttttaatcaatcccctttctgggtggtgtcaggacacccacagaggtgtgggtctaagcgctttgtgagtgtccacgtcctgtgcctaaggaaagcactagtcattcattcattcacccaacagttcctgacggcccacctcaacaggaaggaatattatacagccactaaaatgtaaaatcaccagtgctgttcagaaggacggagatgtttatgtcattggctgtgtgaccaaaagaaaaagttctgctggggatgtgggatgggcatatacgtgttttgaatataagatctttctttaatgctgttatatttggtctccataaaataattattctttgggtgacaacctcttagaaaaagaaagacaaaagcagctatttgcataaacctcagcccaggtgtggtctccagccccaggaaacttctctaacacccctcccatcctcccaccagtggttcctccctcggtggcatgaggtggttcagtttttttcctctgtgcccaccctggggtgccctgggcccatggccactgactgcagtgaacaattatgtgtgagtctgttagttcatttgcattgctataaagaaatacccgaggctgagtaatttatgaagaaaagaggtttacttggcccatggttctgcaggttgtacaagaagcatgacgccagcatctgctgctggtgaggcctcaggaagcttccagtcatgatggaaggcaaagaggacttgacatatcacatggggagagagagagtgagaagggggaggtcccagactcttttaaacaaccagatctcacaagaactcagagcaagaattcactcattaccaggaggtgggcaccaagccattcatgagcaatctgccctcatggcccaaacacctcccaccaggccccacctccaacactggggatcacatttcaacatgaaatttggaggggacactagccgggtgtggtggcatgtacctgtaatctcagttactcaggaggctgaggcaggaaaatcgcttgaacccgggaggcagaggttacagtgagctgagattgtgccactgcactacagcctgggtgacagagctgagactgcaccactgcactccagcctgggtgacagagcaagactctgtccccccccaaaaaaaaaaaaatatatatatatatatatatatatatatatatatatatatacacacacacatatatatatgtgtgtgtgtgtgtgtgtgtgtgtgttaggggacagatgtccaaagtgtgtcagtgtccatcatggctattagactgtcaggcattgaatatgggcccatgttttatttctctttatttcctcattgttgaacacatgggtgtgcctcctatggatgggaccagtggctgactcacctttccaaacttgcatcctgatgatctgtaaagtgtacccaccctgtaagattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttctgtccacgatcatggtggcagctgcaaggtagtgcctgcaggactgctgtgcatgtggctgtttgacaccatgccgtgctgcaaactccacatcttcctagaacaaccaggagaatgccgtggagacttgttgccagatttttgcagttgccctgcagtggagaggttaagagcttggactccggagccaggtggctgggccactttgggggaagtttcccaaattcccacatctcagtttcctcatctgtaaaatgtgcataagagcaaaagccaccaccctgttttgaggattcagtaaaaccatccctctaacacaacactgagcccagtgccgggtatggtgtcagtgtctgccaggtaatggtgtaacgaaaattacaaagcagattgatgtggtgtgattcttgacgttacaaaagcttccttgtttttcagagggagttcccacaggggttctttagacaggcagtgcattaaggttgcagaaatttactttccagaaggttttaaaggaacgcagcttcaatggcagcaaggtacctgaaacaggaacccttccagagtgtctctgttttgttggcctttgagacctgccgcttctgactgcggggacctgggctgccccagatctgtctgtcagaagcctggagttgttaagctggtgaaatttaacaccactgtaaagagcccctcacagacaattcaggaacgcttacagatagaaaccggtcctggttttaaggtgtaattttgcacaagtgttaacaacaagagatggaattggtaacgaggcactggggtcggatcttcatatttttgtcacatttcatcggtgagatcagtaggtctgtctcccctaagaggagtgtggaatttagtgtttttccttttttgggctgtgacccaagagcttgttttcaagatatgtatttatttagaatacaaggctcttttccataaggaaagaaaatgttacagaaatgagctctcagttaattgaataagaaacctgttcgtctcatgactcacttaagagagagctggcagcccttcctgaatgcctattacaggcggcactgtgtccttttacttaatcttcccaaggaggatgagggttgcaggctccccaggcccatcgctgtgttggtgagtgacagagcctctgtaaaggaatggggatgagctctgagcccttttcccgtgggctctgctgcctggaggcatgccctccctcggcttgtcttccagctctcgcacagaaccaagtgttaactggtggtggtttggagacgagaggaaatggaccgtaaggaccattgagttggcataaggagaccagggcccaactccggaccctaccagagcagagtctttctcctctgtaatgtgagactgtagagctctagaatgttccttctccaactcagagctgatgctgtcagggccctgctgcagggtccttcagtggctccctgtggcctgaaggacaagccagctcctgccctggaagccgtggggatgtggtcctagcctgtgctcctgcctcgctcacctccctggaacaccagggccacctctctgggctcctcctgtgccccagtctgctcctgccacccctgtcccaccgtgcttcctccctccctgtgcctcagctcaggccttgccacctggagctctgacctcgtccgtcttggaatgaggcacctgcatgggtagcccatgggtagagttgcagtcatctgtttgctttcgattcactcccgcatcccgacacagtgcccagcacatcatcgatgaatgagtgtggggcaaatgcttgcacagaagtccgtgcgtgagccacgacggtaaacagaggcgctcctcttgtcctaatgtggaactccccaagctacgggaaaggggtgcatatggaccgctgctcactcacggctcagatacttccacggtaatgggttggcgacagtgactcagcttctcataggttcaagcggaagaaatggtgagtcctggagcactgcttgctttgaagtctgtttcagactagggtcatgtttcaaagtttttgaatttcttttttattcaaaagacatttgatgagttgactattgggggaaccttgaccccggtgactccgtgggacaggggatacccccggggtcccttataagcctgctgactcaccgcctgttctccatcttctgtcttccacattagaagcaagggcggggacattgcctttcccggccgctgcggtgtcctggcgcagggcacgtgcctgagggcccttggtcatccgagggaggactgcaccagggacatcagagtgctgatcttacaggaaacggcaaatgaatggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagactgaggcaggagaatcacttgaacccgggaggcagaggttgcagtgagctgagatcacgcactgcactccagcctgggcaacagagcgagaatctgtttcaaaaaaaaaaagaagaagaagctgttctccgtgagtcagccccggtgtctgataagtgtctgcagctgacagctcagagctggtgtcaacccactttggaggctggggtgggaggcaagaaacccagacagaacccctcctggctgcaaaacctccaggcttaactgtggcgcccactccatggtgggtcttaactctcctgaaaacacttcatgggctgtgggcctctcgggtgcttctgcgccagctcttcctcttcacctcctgccacagatctgtgtccccaggctctcctgtgtgtctccctgctcctcctttccctccaggtccgattccacagccctgggctgcctttccacctctgccttctctggggtatgtcctcgcctctcctgtcaccattgtcctcagggatcttccagctttccaggcatttggaaagaggcctccataccttgatgtggcctcccaggttccttgcgacagagtcctgcgtcgggataccaggggctgggcgcggtggttcatacctgttatctcagcactttgggaggccaagacaggaggattgcttgaggccaggagtttgagccagcctcggcagcataatgagattccatctctacaaaaaaataaaatttagccaagtgtggtggcatgcacctgtggtcccagctactcggaaggccaaggcaggaggattgcttcagtcctggaggttgaggctgcagtaagctataatcgtgccattccagcctgggaaacagggtgagatcctgtctcaaaaaaaaaataataataataataataatatttgtaggggaaggacactcagatttcctactggaagcaaggcttcctcattccatcagattctgctcctcctccaaggctcggctcaggggcctgcccctccatgaaccttcccagccctcagcccccttccttcctattcccccagcaccgacgtcacctcatcctgcccgactctgtagcatgcaggcctccgtcctccacccagctgcagaaccggagacctcaggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgagccctggagttcaaggcagtagtgagctatgattgtgccactgcattccagactgggcaacagagccagaccccatctcttttgtttgtttgtttgtttgtttgtttgttttgtttttttgagatggaatctcacccaggctggagtgcagtggtgagatcttggttcactgcaacctccgcctcctgggttcaagcgattctcctgcctcagcctcccaagtagctgggattacaagtgcccaccaccatgtctggctaatttctgtatttttagtagagatggggtttcaccatgttggccaggctgatcgtgaactcctgacttcaagtgacgctcccacctcggcctcccaaagtgctgggattacaggtgtgagtcaccgcgcctggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagatatgtatttccgcatctttacggagtctcatcaacgctttttaaacctcccctgggatttgaaccagcgcccatagatacaggtggcttgtcaggtcagctaggtgctgctactgaggcagcatctgtccctagccccgcacccacaggttcagaaggggaacgcttcccccgggtggcttatgagatccagtacttctagtttcacttctttaaaaataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttcttttttgattggggagactggtgtgcatagaagggaggtgtcagctaacgagactgttacctcaccacagatgcccacccgtgggtgatggagctcccaagtcctgggccacaccctacgtgccccatgcccagcaagttgggtgggggaggggtcagtacatgtttgtaagataaagaaaaacatccttcccaatcagccgtattacccagagggtgatactgatttagatcttatttcagtttggttagagaagctcaggtaccagtgagcagaagtctggccattgtggtggcttctggaagatgatgtgccatactgttagcaggggtgcaatttggggtgtgaggccaccagagctttgatttccgcccccgccgcccccctccaacccccgccccgccggattatttggagtttttttattgttgttcatggtaattacctgctattagacaacaatctagttccatttgcaatagggaataatacgtctgtgacacagtctccagacttagggagcctctggccaccccgagggggccctggtcattctgctgctggtcatgcctagctctgggtggccgactaggtggcctgggcgggagggtccactctttgcctttataaaaagaagggcttgggccaggcgttgtggttcatgcctgtaatcccagcactttgagaggccaaagcaggaggatcaccttaggtcaggagttcaagaccagcctgaccaacatggcaaaaccccgtctctactaaaaaatacaaaagttagccgggtgtgtggtgggtaccagtaatcctagttactcgtgaggctgaggcaggagaatcgcttgaacccgggaggtagaggttgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctctaatccccagcagtttgggaggccgaggtgggcagatcacctgaggttaggagtttgagacctacctgggcaacatggtaccccgtctctattaaaaatacaaaaattagccaggtgtggtggcacacgcctgtaatcccagctactcgggaggctgaggcaggagaatcgcttaaacccaggaggtggaggccgcagtgagccaagattgtgccattgcactctagcctgggtgacagagcgagactccgtctcaaacaacagcaacaaaaaaggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaattagccgggcatggtggcacatgccattagtgtcagttatttagaaggccgagacggggggatcatttgatcccgggaagtgaaggtgctgtgagctgcgatcctgccattgcatccagcctgggcaacagaacaagaccctgtctcaaaattaaaagagagagagaaacaaacatggcagctcagaaacctggctgggggtgattgtggggaactgctgctgacgggctcttgggcacacccctcactccagccattctgcctggatgccttaggaacactcctcataccctcctaagagtcccatccaggccgccatggctcacttatccctgccacgtggactccagaaaacattctcagtagaaacccacagaaactgttcccagtcacaaagcacgccaggtgcatcctgttctttctgtcatttaaaaaaatgaatgtgtctctatccctccttcttataaaacagtaccctctcaccctgcatggcttaaattctggtctatcttacgcctttggattcaatgaccttcatcaaatgtctgcaaggcaagggccatttacagtaaacatggtgggaacttagcaatgtacttgggaaataaattctggtcaccaaatagagaagcaaatgcaacaaataatcccacagaccattataaaatgtcttttagacgatagttgtcaagaattagagttactcgtccaaaactgttgttggtgtttggaagcatccaaacatcggctggcccatgtcccataggggcgtctgcttagcaccctggtgagtggagagttgtgtgtatggggacttagcagagtgggaagcagcttgcaggaaggttgccaacgcttattaatatttaccaaaaagatgcaggaccggctgcggtggctcacgacagtcctcccagcacttagggaggccgaggtgggtggatcacctgaggtcaggggtccaagaccagcctgggtaaaatgtagaaactccatctctcctaaaaatacaaaaattagccgggcatggtggtgcacacctgtagcccagctactcgggaggctgaggcaggagaatcgcttgaacccaggaggcggagattgcatgagatgagatcgcgccactgcactccagcctgggcaacaaagagcaaaactccatccaaaaaaaaaaaagagagagagatgcaggaccatctgcctatgttccattttggtgatgatatctgaccttctgggagagagaacatcttaccccacagacccaggaaggcatgcacatgaggatggcaggagagtggctgtggacacttcctgtgtcaccatcctctgctctaggtgtgtactggtcacaggcacaggacagaaggctccccagagtccgatcccgtctcttgagctcagctggctatcctggaaccccccaacccgctgacctttggaagtggacagcagcccacgcctgcaggtggtccggccctgctgtgcagccctgttacagcacgttgtgtttttctggcttgtctctgccaagccccatgtgaccatggagggggccccgagcagacctgggggtggcggtactgaggcagaggcaggcgcacagtggtttccaagggagaaaatgaattcatgatctaaaatgcaaaaccttaattatgcctgactcctttcctccctccctccctcatttctctccctccctccctccctccctccatccatccttccctcgtttccttccctccgtctttttccttccctcccttacttccttcctctcttcctcctacccttcattgacctttcattttgtgactttgtcaaatacagccccaggctatcttctctttctcctctgctccaggttgttttctcttgctcctctgccgcatacatacccttccaccctgcgtctgcccatggaaatctcgtgtcccctccagtattcctgcccacagtggcctttgttaggaaattccggcacagtctcctcacagggcagcccttctgggaatcgctcccctgcgctcgtgtgcactcccctgcgctcgtgtgcactccggcccagccttcagagctgcttacctggctcttgtcttgtgtcctctgaccgcccatcagggcctgcccatggggctctgtctgcaggggagcagccccaaacacagtccttgtcagcacgccgatctggacctgaattgggcccttgcacacactagctgtggaccgaagacaaatcaggttctccccgtccccagagtggggaaagcggtagtgtgggcctccctggggtgcccatgatggtgtaatgagtgcgtgcacggagcctgctccacgtctctatggacatttccataacttttcttttggtttgtttttttgtttgtttgtttgtttgttttgttttctctgagacggagcctcactctgtcacccaggttggagcgcagtggtgcaatctgggctcactgcaacctccgcctcttgggttcaagagattctcctgccccagcctcccgaatagctgggattacaggtgcccaccaccacgcctggctactttttgtatttttagtacaaacggggtttcaccaggttggtcaggctggtctcaaacttctgaactcaaatgatcctcccgcctcagcctcccaaagtgctgggattataggcatgagccaccaggcccagctaacttttcaatttataaacactaatacctacttgtgtcccgtggcctcatctcagccatgtgaggccgatgttgtgcccattgtacagatggcagagcgcagctgtgtgtgcagtgcggattgcaggactgtgcctgagtctgggacagggtctttgccacagctcttgggatcctctcttctcatcaatgttatctcagagagctttcactgttggataagaggttgaccctggaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgtgtgcagtgtggattgcagggctgtgcccggctgcaggaacacatttactggatgtgtgcagcacggattgtagggctgtgcgtgggctgcaggcacacatttactgggtgtgcacagtgcggattgcaggactgtgtctgagctgtaggtgcacatttaccgagtgtgcacagtgtggatttcaagacttagagatgagacagccagttcctgtcctgcccaagggtcgggcagggatacgcatcaaagaccctgggcatctttcccagcccgggcggtgcccccagccatcgcttctcagcaggacagccggcagggcatctgtcgtcttcgtccaccagcatcacgacctgtttgggggagaagtagtatttccacaccccactcagggcgatagcgtttgaggaagaagagaaagagagacttttggctttcctgatttcaatctttctgaaggtggacccatcactggtgaaaaaaattggtttttttggaaccaagaaagcagcctcggcctccagtgcctgaccaggctctggccagggtataggatcctggcgaggatgctgtgctgtgttgggcaggaagccacttcctccctctaaacgtcagtgtccagctctctcttcgtcgctttcttaagttgagggagctgctatgccaagggcaagcaagaaacaggcccctgagcccccaggttcacggctgggctttgaagcaggagtttcctcttcgccctcgggccacacctctgtagggtgcctctgcagcatttccctcctcgggcaggagcctagcttgcagaggacagacaggcaggaatgctggcctccatcgtgccaccagatcctgtccccaggcaagcaggaggggaggggaggcagtctcatcactgcagcaggaggggccacctctggagtccgcatggctgtggctgggctgtgcttctagaagcagcagctgtcgcctccactctctagggatttttatctttcctttacaaacttttttttacctttttttttttttttttttttttaagatggggtcttgcttgttgcccaggctggtctcaaattcctggactcatgtgatcctcctgcctcagcctcccaaagtgatgggattacaggcatgagccaccgcgcctggccgatttttatctttcctaccagccttttcatatgagctgagcctgcaggctgtgcctaagcatagccctttgaacttgattgaccatgagctttgaaaggctgctttgcagtctcagttctctggcaaatacaccagctcggttaagacgacttttctttgattgatgtcggctacatctagaaagcaggattgccaccactcctcgaagcaccccacgattagagtgtctgagcgctgcttctgctctgctgaggctggtgacaaattgcctggaaagacctcctgacagaggatgacgggctcgtctgcagcagggccgcttgcagcccaattgcttccaagattaaacctttccaaggcagtctgcactgccccatacacagttgggctgcttggtttaagattatggatgaatgtactgaattggatctcatttaaaaatatataggttttgaagtttgagggctcaggaagaaaatgaaatcctttgtcccaaaccagggcctggttttatcagtggcatgcgtgcgtgtgtgtgtgcgtgtgtgtgtgcatgtgtgttctaaagagaccctagtggcaaggcacagtggcttatgcctgtaatcccagcactctgggacgccaaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactcatgggcctcaagtaatcatcccaccttggcctcccaaagcattgggattacaggcatgagtcaccatgcctggccataggggaagatatttttaaacaagatttgcttttgactagtgtcctgcatttgttaaagaccctagattgctccaggtgttctaaaaataaccaagcccacctgcctgccttctagatatgggctggagggcctgccaggagcattcttggggattgccagtagccccagttagcccaggctgacttacacttcctccctctcttaaccaaaataatgttgaatttttgtgttccttgtcttttaactgaaaagctcctgtttgtttgtttgtttattttctgagacagagtcttgctctcttgcccaggctggagtgcagtggtacgatctcagctcactgcatcctccgcctcccaagttcaagccattatcctgcctcagcctcccgagtagctgggactgcaggtgccctccatcacaccaagctaatttttgtatatttagtagagacagggtttcaccatgttggccaggctggtctcgaactcctgacctcaggtgatccaccgcctcagcctcccaaaagtgctgggattacaggcgtgagccaccgcgcccggccccgtttggtgtttttaatgctgtattgccattatttgcacttattcttttgcaaaatttcagcacctggtggtcaggatgttcctcctggccatgcacatgcaggacacacaacaggttcttgataagcgtgtgctgagcaaaactcactccttccttctggacacattcatcacaggtgtgctcgaagcagcaagagcttgcccctgctcagaagtgcttagttgctaattagatgtttccgcaaaggtactgaaattggaggcatcagtgttcatcctttagctatagcgttggaaaaatgtgattgatttacaactgtgactaaaaaggtgtttagagaactgttctatgtaaaacaagacagtaagctgggcacggtggctcgtgcctgtaatcccagcactttgagaggctgagatgggtgagttgcttgagctcaggagttctagaccagccggggcaacataacgagacccccatctctataaaaatatatattttttaaaaagctgagtatggtggtgcatgcctgcagtcccagctactccagaggctgaggcaggaggatctcttcagcccaggaggtggaggttgcagtgagctgtgcttgcaccactgcactccagcctgggcctcagagtgagaccctgtctcagaaagaaaaaataaatatatatagtgtgtgtgtgtggttgcaacttttgcacatcaccttgagttctgggcaaggggagaggaactgagattggtcactcccttcttgcgtggatggctgtgggatttgggtgagttttttgctccatagtgcttttcaccctgtattttctcataggttttgccccactggggctttgtatagagattggggctctcaggtcccatatggcacttactagcgagagttccgagtggccagtcccctccctgccctggcattggtacaagggggccttgctgttggaccacagtcttccaagagtccagctcccctgttctatcgagtctgaagcaaggtcccacttgggagttacagatcaggctcctttgatgtcagagcatcgcagcggaattctaggccacccggcagtgagtgctctctgcagatctgtgagtggtgctgggccgccctgccacctccatccctagcaccgtatctgtgtgaaaaagctgtgacctgccccttgggtggaagccttccagtccttggaaggggaatctttgctgctgctactgtctgcagagagactctttttatttttatttatttattttttttgatggagtcttgctctgtcacccaggctggagtgcaatggcacaatctcggctcactgcaacctccacctcctgggttcaagcaattctcctgcctctgcctcctgagtagctgggactacaggtgcttgccaccacacccagctaatttttgtatttttagtagagacagggtttcgtgttggccaggctcgtctcaaactcctgacctcaggtgatctgcccgcctcggcctcccaaagtgctgggattacaggcgtgagccaccaagctcggcccagagggactctctagagaggccccttgatcccacaaggggcgggggtctctggccaggcacagcccctccccactaagcccagcacctggtgccgaacacacacacacacacacacacacacacacacacacacacgcccgccccccgctccactgttctgttgtcagttgtgttcgttgttttcttgtaaataaacagtatgacaataaagggaagttacttcttagctgctcagaaggtgaccagagcagggctggagtgccagccttgcattcattgtttgctttattgcaaggctgcttggaattgaaggggatctccgttcgagtctgagctggaggaaggaaggggctcctgtaccatgtatagaacttgggctctccccggggtcaggggcctgggctctggtgcagccccaccacttcatcaggtcaccccaggtggtttcagcctctgatttctcatccctggaatggggtgtttgcagcctcgtaggttgctatggggattgaatgagatatgttcatgagccagtaaggcagccaagatgtcacttacatggaacttacattgcaaccccagttttagaataacataggatattaaatatcaccatctccttgaatactcatagtccgcagtttgcttcatgttataaggtgtttagttctaggctgagcctgtaatcccgccactttgggagactaaggtgggaggattgcttgaggccaggggtttagaaccagcctgggcaacatagtgagacccctgtctctacaaactatatgtatacacgtataaattttataaagatgtttagttgttctgaatttcctaaaaaatacagcttaacttttttgtcttcctttacctgcacctggatgcagtgggaaagattttcccagtagcacaaggtggaccaggtgagctatcctcacccaatggggctgaaagacagggctttgatatcctgccccagagcccggctgttaccacatggtttgatttgcgatgccaagcaggcttccttacgggtccacacacctctggtttttagcttgagattggggcagctgttcctcctctggcccagccaggtataatcaggtacaaaggaaagtgacctagaatgaagaggttgccctgacctggtggtggaattggagcctgggagcacgggtcggatggcttagttcatctgtttggcagtggatcaaatccccctcctcccacatacttgatttatgtggactgggaaagaatgttgggtttcaacataaagaaaacaaatttggctgataactcgtaaatcacaataaactttcattccaagagtgttctgggcttctaagaaatatattcctatctcacatctcagttgatattcacagccaccattgagctagagtcattcccaggtggagaaactgaggcttgggagttatgcctgccttggagagggatggggctaagacttgggctctggtgtcctgaccaccgagcctggttccttccacgtggtctgattcctgggatgtgaagcagccatcctcacagggccacacacctggacaggtacacagtgcagcaagtagagaggcaaagaaacaagggaattgatcaggggtccacacgctttctctaaaagagcctggtgctacatatgttagtcttgacggagaaagaggcaaaatcaggatatcatgtaggcacttatataaccactttaaatgcaaccatttaaaagtgtaaaaaccattcttagctcatgggccataaaaatcccagcagctggctggttttggccggcttgccgcagcttgctgacccctgggagagagcatctgctgctattgcaggcaggggactgcaggtcatccccctgtttgggtcccactcctgcccgtcattcaggctctgtcagcttctacccagaagtacctgggagtcgggggttttgctgtgtcacagagaacttggctctcgatagagtcggaaaggaattctgggaaaactctagagatgcattaaaaaatctccactgggccgggcgcggtggctcacgcctgtaatccctgaggcaggcacattacctgaggccaggagttcgagaccggcctggttttttgttttgttttgttttgttttgttgagacagggtcttgctccatcatccaggctggagtgcagtagcacgatcatagctccactgcagcctcgagctcctgggctcaagcgatgctcccacctcagcctcccaagtagctggaaccacaggtgtgcaccactgcacccgggttaatttttttatttttgcagagacgatagtctccctatctttcccaggctggtctcaaactcctgccctcaagtgatcctcctgcctcagcctcccacagggctggggttatagacgtgagccactgcacctggcctctttcttcttgaggctagttttcctgactgcgtgattcccaaagcttcaccccactgatgctgggttcccctcctctgtctactccacctgctgaggctggggctctcagggacacagtcagcagctcagcctctggaaagacctggaaagatcacatccttctgggaacctgcttctggaggcacaagtagtgtagctcctcttaggccctttcgatgaagtaagagcagctcattagcatcccaggctacaaagcctaaaaccctttgcttttaccaaaaccagagggtctaaagagaaaggtcacgaggagcgagcggccgcgtggatgaggttggccagagaaactggtttgttttggaagccgatggaagatgcgcttggaaggctaaggctgccgaggttgaagtccgtcattctcagtgcagaccctagggaggaagtagcaggaccccagtggggctgcaggcattcagaaagagagctgcctggggtttcccttcagaacctccctccttttaacccgggagtaaagagaaaaagacccgcggggtccactggctcggaagtcggtctctttcagtttggagcctccagttggaaacctgccttttaatggccaggctgatggtctagttactctttgaacagggaagcctcgtcaggctctctgctgaccacgcctcagtgctccctcgaaggacaactctggaatgccagtttttatctcatctcggtagaatggattttttttcttttcttttcttttctttctttgagacagagtctcgcgctatcacccacgctagagtgaaatggcacgatatcggctcactgcaacctccgcctcccgggttcaagcaattctcatgcctcagcctcccgagtaactgggattacaggagcgcgccaccacacctggctaatttttgtatttttagtagagatggagtttcactatgttggccaggctggtctcaggcgatccacccgcttcagcctcccaaagtgctgggattacaggcgtgagccaccgtgcccggccctagaatgaatttttcttttagggaaaataaggttattggtgaatgggtttgggctgtcatcttcagaaactgatttcatctagaacagtttgtgacgggcagatgtggaataaaaccactggatgcatcaggcgtcactgccaagggtgcaaggggctgctccatgctgggcgtgcgagaggagcaagaagccgtccccgcccaccacggtgcaggccgggatgcagcggaaagcccttgcttcttagatttcccacacaaaagtgtatttcttgtagatttcgccagcgcgggcctcctcctctgcttggcagtggctctgcacgagctgccttgggatggatctctcatctttgctgctggcctcatccaaggaacagaccccatgcacggagcctagatgccccgaggtcttcactgatggccctctgaatttttattttgtttgtatttcatttgttactgattgaatttttgagacagggtctcgctctgtagcgcaggctggagtgcaggggcgcgatcctggctcactgcagcctcggcctcctgtacctaagccatggccctctctgactttgaacccctcagttcattctcagatcagaccactcactcactgaggccctcggctcttccacaggtctcagccttttgccccttatagtttttagttgttgcagcctttctgttctcttcccctctcctgttaaggggacatttccaagcaccctggccacagaacctcctcacctcccaccctccgcccctgggtgccagggcctgggttctctgtggaagtcctgccagctccgggtatttcccacgtggatttctcatcatcttcaccaccagatcagttcctggcctgcacccctcctgtctggcttgtggcaggggctgccaccctcacctgggccctaaacttctacaaagccccactctctcctgttcccgtcagtctgcttgccaagtccagtttattttaattctggggaacgttgtcttcctcctcccccctccctcgccaccacccacctctggtgttttttttgttttgttttgttttgttttttttgagatagagtctcactcttgtcacccaggctggagtgcagtggtgcgatctcggctcactgcaacctccgcctcctgggttcaagcgattctactgtctcagcctcctgagtagctgggactacaggcacccgccaccacacccggctaatttttgtatttttagtagaggcaaggtttcaccatgttggtcaggctggtctcgaactcctgacctcaggtgatctacctgccttggcctcccaaagtgctgggattacaggcaccacttctggttctgttaccttcgtccaaacttgtatttcccagctggtatcttccatctccaggctttcccctctggcctgtcctttagcaggagtcaccttcctgaagcagaccctggtctggtctctgcgtactaccttttgcatggttggtggccgtccacccgcctctcaggccatgtctgggttcttctaggggcttcggtgatctgggagcctgtccccgctggccccctctcccatgtcttactccatcagcttcaccttgtttgtatctctggatctcctcttttttccttctgtttgtatcttgtctctttctagaaagcccccccacctctactcgcccctctgtggcaaatatcacccaattcaggtgcccccagcccagcaaagagggattttcattccttgggcccccgttgtaggctagctgcgcctgtctttcggcacatttcatttcctgcctggtatttcggtcgtgtgcgtgtctttattctcctcgtgtaatccctgaggtgcagagtgcgtgtctgtcctcctctgccctctctagagattgggatatgaccagtgttcagcccccaaccaaaagagcctaagaaccccaggtccccagcctgtcctgctctgctgggggcccacatgcctggggacaaggcacctttccttccctgaccttgactaggacaggacatggggtagggcctgaacattgagcaattgtcaaactgcctacttacgatgaacaaaatagcttttcaggaggcgagaccacagcacagtcatggtgaatcctgatgcgcaccccaggtcttttatcaggatttttgtttttcctggtgggcacagatgtaggtggagcagatcagaggcctctcaggttcttgatcactcatggcagttcaggcctgccagtagtgaggtcagagatccatacagcaggggagagaagggaggtacagggaaccctcggccccgcgtgctccagcaggtctgcatgattaacctgaattgcagtgttcagaggctcggcctgccagccacagcggttccagatgaaatgcagcttagaaggcagcatggtgtagtagctttggcgccagccgcacccagagtttggattgtagccagatggcctcaggtgcaatgtataacctctgggaattccagatttcctatttacacgacagggatgattccatacctgaagggctgtttggaagcatctagaagcaagcacagtggagtggctgtcatgacgctgaccgcacaaatgatggtgttaggatccctccacggatgtggccaggtgacacccctcacctaggccgcacagcaccctaatgtacacactgaagaaaggctgcgtggggctgcagagcggctcatttctaagaaggccaaagaaattgctcagtccagaccagggaacccagtttctcttttagaggtgggatcttgctatgttgctcaggctggtctcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacatacatgtgatgtacatacctgtagcttccgggaaagggaaggaagtagagatgacattgtctgttactcgtttgtatgtgtgtgtgcgtatttaagtaaatatgtgtgtgcatagggacatgtcacatgcatgtgtggcacatttataggatgaagaggtgtctaaaagacattgaggaaactcagtgaaggagttctgccggcgggcgtgaggaccacgctaaaagatgccggttgtgctttgtgtctaagctgaaagcatggatatcattttataaaagtaaaattatattggccaggcgtggtggctcatgcctgtagtcccagcacattgggaggccgaggtgggcggatcacctgaggtcgagagtgtgagaccagcctgaccaacatggagaaacccccatctctactaaaaatacaaaaaattagccaggcatggtggcacatgcctgtaatcccagctactcaggaggctgaagcaggagaatcacttgaacctgggaggcggaggttgcagtgagccaagatcatgccattgcactccagcctgggcaacaagagcaaaactccatctcagaaaaataaaaaaaaaaagtaaaattatattgttattgacggtctctttgttcgagtaagccgtctctggatatatcattgtatggtgtattcatgccaaggatttggtgtgagtcttgaagcattcacaccaaattgtggccaagcccagcactgagagcgcagtgggcgttcggaggacacgtttggattttgtgatcctctgcctggcaggagctgctcagcccctacagccccttccccgagaccaccaatgcgtttctcttcagttttgctattctcatacgctggtgatgggattttggagacaaacatggtctcttctgcttgcttgcttgcttatttatttatttttcctcccaggttcaagtgattctcctgcctcagcctcccaagtagctgggattacaggtgtgcgccaccatgcccagctaattttgtgtttttagtagagacgggtttcaccgtgttggccaggctggtcttgaactcctgacctcaggtgacctgcccaccttggcctcccaaagtgctgagattacagacatgagccaccgcgcctggccttctgccttttttggtgaactccctgtgggtgggagaactacccggtggagtcggtacctaaccagggcaggacacggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatgctggttgacgcttgaatttatttatttatttcagataattttggactacagaaaggactctttgaaagggtattctaaaataatttcacccaattaggttttaaacatagtctgccatattgttgatttcacaggatttgcttttttaaaaaaatgtattttatttatttagaatttttctttaagagatggggtctcactctgttgcccaggctggagtacagtggtgcgatctcggctcactgcaacctccgcctcccgggttgaagcaattctcatgtctcagcctcccaagtagctgggactataggtgcgtgccaccatgcctggctaatttttgtatttttagtagaaacggggtttcaccatgtaggccaggctggtctcgaactcatgacctcaagtcatgcacctggcttggcctcccaaagtgctaggattataagcgtgagccactgtgcctggccttcagtagcttttaaaggttgtagctgaagattttgtacttgtcacatgggggaatatgataatgaaagcagaagatagactagtcactctacttttcccagcgtcctctctgactggactctttgaaggtactgcccagggtcatgaagagatggccctggctgcttccagaaggtatacattcccgtgtccactctgtgtcctggagagtgggggcggggggagggggttgtccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcaccatcccagggttatgaatgacgttactgtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgactcatatgcaaacgcttctcatttcattttgttatttttttgagaaagggcttgttctgtctcccaggctggagtgcagtggcacagtcacggctcactgcaccctcgacctctctgggctaagccatccttccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaagaaaaaaagcatctaaaaattgtgaggttaccgcttagctctgtctttctggctgcacatgggttaccaggtgccttgccaagaccctgcctccgtgtccaccatgctttgtgtctgcaagtagatttacccatcgttcattattaattattcctctgagcagctctgtgaagctagtaaatattaataaacaatatgtgctgattatgaacctaagacaaaaggatgtctttttcaagctgcttaattttaggtaaactagttgcacacaagcgatgaataaacgtgaagtcaggcatccaggcggtgaaacaaaatcaaactggaactgcaaaaggagagtgcctgagatctgattttattttatttttgggatggagtctcactctgtcacccaggctggagtgcagtggcgtgatctcggctcactgcaacctccgcctcccaggttcacgcaattctcctgcctcagcctcccaagtagcttggactacaggcacacaccaccatgcccagctaatttttgtattttaagtagagacggggtttcactgtgttggccaggctggtctcgaactcctgacctcaggtgatctacccacttcagcctcccaaattgctggggttacaggtgtgagccaccgcatccagccgaaaggatacagtttatttaaagacaaaggaaaaagaaaaaccataattgtgttcacttagaaacatctcccatttcatactgatgtctttcctggtggtggtgtccaaatgcttatatgtgtgtgagattcattgttaccatgttgggatcagactgtaaacaagctttataaaagttcgtggctcctttcactcatccacccgctatgcatcgtccagatctgagttcacgtgctccttccccaaaggagccttctctcctgtctagggtcaggtctgcctctttttttctttttctttttttggaagcagggtctcaccctgtcaccaggctggagtgtggtggcgcgatcacgactcactgcagccatgacctcctaggctcaagcagtcctcccacctcactcccaagtagctgggattacaggcacatgccactacacgtggctactttttaaaatttttttgtagagatgggatcttgctctgttgcccggggtggtctcgacctcctaggctcaagcgatcctcccttagcctcccaagtagctgggacgacaggctcatgccaccacacccagctaatttttttgatttttagtagagatggggtctggttatgttgcccaggctggtgttgagctccagagctaaagcagtcctctcgccttaacctcccaaagtgctgggattacaggcacatgcccctgtgcccggccaggcttgcctcttaaactcccttcgctccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattacactgagccatgaccacacccctgcactccagcctggacgacagagcgagacctcgttccttacaaagaattatactgagtacctaatatgcaattgcattgctttagtagaattctctcataagtactcccctggtgtcggaatccacattgttcccagttgttctctgttctaaactcatgctgaacattcttgtgcataaatctctgcctacatctctgattattcttacggatagactcctgaaagtactaagaggaaggattaatctgcgttctgattttaaacagcccatttgtctaaatattagcagggcctaagatctggaataaatgacacagtggcaaaagtcggagtcacacgtcctggttggtttcagagagtcctggggtgaaatggtgcctttggggtccatccctgtctagcacaggagtcccctttgcagcagtgtccataaaacgttagcttgggctgggtgtggtggctcatgcctgtaatcccatcactttgggaggccgaggtgggtagatcacctgaggtcaggagtttgagaccagcctggccaacacggtgaaaccttgtctctactaaaaatgcaaaaattagcctgacgtggtagtgggcgcctatactcccagctactcaggagaattgcttgaacctgggaggcggaggttgcagtgagccaagatcgcaccactgcactccggcctgggggacacagagagactccatctcaaaaaaaaaaaaaaaagtgagcttggtgatgagtctgggaagagcatctcttcattcattcagtccacaagtattcactgtgtctgccccgaacctagcaccatcctttggcccaggaatagaacggaggaatgtacatctcctcaaatgtctcctagaaattgagacctcaccattctcgctaagctccctgagggcagggactgtgactgtctcattcactgctcgtagttaatgctcaaatggtttttgaataaattaaaatacaatatgtgggccagtgcggtggctcacgcctgtaacccagcgcttcggtaggccgagatgggtggatcacctgaggtcaggagtttcagatcagcctggccaacatggagaaaccccatctctactaaaaaatacaaaaattagccaggtatggtgacacacacctgtaatcccagctactcaggtggctgaggcatgagaatcgcttgagcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacatcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatacggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaaagaaaagaaaaagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcctggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatgctcagaatacacagagctgtggtggattgccagcagaagtgccccgtgtgtggttgcaacaggcaggttgttggcgctacggccttcaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcattctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacatgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatgcttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcacgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagggggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacggaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccagaacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctgcgtatgccccatttcgggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgatcgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactttgggaggccaagtcaggcaggtcacttgaggtcaggagtttgagaacagcctggccaacatggcgaaaccccgtctctactaaaaaaacgaagtacaaaaaaattagccaagcgtggtggtgggcgcctgtaatcccagctactcaggagactgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcagctgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggatgtatatatatatttatggggtggagcacatgagatgttttgatacaggcatgctacgtgtaataatctcatatggaaatggagtatccatcacctgaagcatttatcctttgtgttacaaataatccgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttgtcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgcgttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatatttccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacctactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcgtgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagtcacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggcggaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaacggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctcctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctggacagactctgctacccacctgcctctcttagaagagccccaggttgcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaacttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcacgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttatataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgagggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcgacacccacaaccactgcccagcgcatctcactcggatgaaagcagtgacgtccgagggttctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttgagctctttgtttttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatattgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttcttttattttttttttctaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaaatatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattggttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggagtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctatcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatattcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttctctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactcccgtctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaaaaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctattatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcgagaccagcctggacaacataacaagacctatctcttaaaaaaagaaaaaaaaaaagatggtgtgagtccattgtgtgttgctgtaaagaaataccttagtctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacactggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccattgccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtgtagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatctttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctgacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgcatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagggagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctctttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacgagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggcgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcgggtggatagatggatggatggacagacggatgggcagatggatttagacagactggcaaaaatatttgcaatatatatgagagagagagtgtgtgtgtgtgtgtgcgcgcgcgcgcgcgcacgccacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttctttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatcttttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacagggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccaaggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccaggctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaacaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccacttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacgtccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcacggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaactttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttaatagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcgcggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccgagtctgaattggcagatgttgggtctgtcctttccttgacggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaactttttttttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacgtgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcgtgttccacgggccatgatcagccatggattctctgaggaatatcccattgcagcccagacattacccgcacactgggccaacaggcagcatcatggagggaggaggacaggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgcgtgtgtgcgcgcacacacacactctcccccccacacacacacacccacacacgcacacacactcccacacacacactctcccacacacacactcccacacacacacacacactccccacacacacacccccacacacgcacacacacacactctcccacacacactcacacacacacactcccccacacacactcccacacgcactctccacacacacatgcacacagagtcccacacacacttctgcacacacacactcttccacacacactctcccacacacacactctcccacacacacccccacacacactctcccaccacacacacacacacattctctctccctcacacacacattctctcacacacacattatctcacacacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggaagcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtaagggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcatggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttgcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggtcaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagtattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccatcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatcttttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgggaggctgaggcaggtggatcacctgaggccaggagttcgagaccagcctgggcaacacagtgagaccccgtctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagcctttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagcttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacaacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcacagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacctgggaggaggaggttgcagtgagcagagatgacaccactgcactccagcctgggcggcacagcgagaccccatctcaaaaaaaaaaaaaaaaagaatgggcatcccaggcccttgagtggctctgccccagcccaccccacccccgtccccgccacacacacacacacacacacgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatgcaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacagggggcccttccctgcctggcagccgaggcagagagagagaggagacaaagagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattccgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccagccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggggccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttcttttttttttttttttttttttctgagacagagccttgctctgtcacccaggctggagtacagcagcacgatctcggctcactgcaacctctgcctcctaggttcaagcttctcctgcctcagcctcctgagtagctgaaattataggcacccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacagagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctcgggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcatggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagctcaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaa

SEQ ID NO: 778 - DNA, 442331 bp, Homo sapiens
cctcggtggcggcggcggcggccggctccaggccgggttttggcgccgcccgcctgctgcctcctggcggctcctgaactccagccccctctctatcagccgctcactccgtctcaatatgtctcaagatggcggccaatgtgggatcgatgtttcaatattggaagcgctttgatttacagcagctgcaggtcaggctcctccgcgctcggcctcgcgcccgggggtgggggctgcgggcggtcgcggcctccgccgggggccccgggctggcccagccgccggggggcccgcggcggcggggaggaggggggtgccgggcaccgcggggccgagtcggggccgagtccctcccgctccccggcccccattgatcactcgcttgatcggaaattgatcctctttgttcaattcatcgatcagcccaagatggcgccgggagccgccgccgccaccactgcccccggtgtctgcccccaccccgggcgcccccccgggccccgcgccgccgccgccgccagcgccgccgccgccgttgccgccgcgggaccggggagggggcggccccggcggcccgcggggtgcgcgcgcgagcggggagcggggagcgggcggcggggggcgggcggcggcgggcgccgggagggggccgcggcccggcggtggcgcccgcccgcccgctcgccccgcgcccccggcccgccgtattcccggggaaagtttgtggggagttgctgcggggggtgaagcgcctgcctctccaggaggagccgccgccactgccgccggcgcggcggagctggggctggtggcgctgtggtgccgccggctcgggggagggtcagagcggccaccggcggcggcggcggcggcgcggcccggctccggccaggcgggcgggtggccgggcaggcgcccgcgctcgctacccccggccggccccggccgccgcccccggctgtcaccggcccgggccgcgccgccgctccggcaccccgcgtgtggctcccggcgcggacccccgggtttgtttacgtcccggggagcgccccggggccacccgcgcacctcgcggccgccgcgctcttttgtgtgcctgtgtcggtgacgcggacctgttcctccgtggcggacccccgcgggggctctttggggaaacttggcgaggggcggcgggggtgccccgcgcgcagtgtcgctgggtcccggtgtcccggaccgccgggtgcgggcgcgggaggaggaggctgcaactttcccctaggcaggccccaagctgttcccccgggtgcccgggcagtgtacgctgcctccccgccgccggtccgagccgcgatcgccgcgcgcctgggggctccggcggcccccggtgacctgcggcgccgggtcccttccttgcgtcccctcggggcttctgccctctctgcagggcccgccatggagcgcgcggcgggtgcgctcggagatgccttctcgggccgggttctcgaaagcagagccccgggggcccgttgggaccgtggcatgccgggcggtggtccgcgcgcggagtccccggcgccgcggggggaccgtgccggggctccccggcccgcgcccgagtcgccgccgtgcccaaggggcgagtgcctgcctgccaccccccgcccggaggagcggcgcacccttagggtccgccccgcacgtgccagctcggcgcccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccccaggaacgtctgtttttagtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgctctatgaaaagtgacttttattataattgtcaaagacagaaatttgtctgtcttgtccttttgttttgtctgaagccccgcgttatcgctgcagagagagagttttggtttccaccgaaatttccctgcctccgattgtttaaaccagacccttaatcttattttaacatatttaaaatgttcacaaaacccggaagaattgttttgtgtaagtagcaagcgagtgtagcttaaacactcaagcaattctggtatctaattggaaacaggtggaattcttggaatcccatgtttgagtctttttatagcaaagcccagggacacttttcacttatagccattcgttttgtcgaagctatttgaagaggggccccacagcctctccttatgtcccactgttgcttacctggacaaagcagtcgtgctgggcgctttaggaactggatacctgtgaatgcctggatgccgagagaagtgtgtgtgtgtgccgataatggagtgaaaaaggaatctaatggtatagttagacaagcaatttaatatctgcattgttatatgactttagagcaaagaatttgtgaattcatttgtgatttctgacttgatgaaccttgactgaccagagcatgtaggtacattttattataccccaataatgatatagaattcagagagaagatactcccccccgcccccaaaaaaattctacatttagagaatataagctccaccagcaaccataaaagtattaacttggtgagggggatattttctttctttttttttttttttgagacagagtctcgctctttcgcccaggccggagtgcagaggcactatctcagctcactgcaaactccgcctcccgggttcacaccattctcctgcctcagcctcccgagtagctgggactacaggcgctggccaccaggcctggctaattttttgtatttttagtagagacggggtttcaccgtgttagcccggatggtctcgatctcctcacttagtgatccgcccgccttggcctcccgaagtgctgggattacaggcgtgagccaccgtgcccggcccctattttcttttcttttctttttttcttttttcttttttttttttttttttttttttttgagacgtggttctgtcgcccaggctggagtgcagtggtgcgatctcggctcactgcaagctccgcctccagggttcaggccattctccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattgcttgagcccaggaggtggaggttgcagtgagctgagatcgtgtgactgctctgcatgcagcctgggtgacagagcgagactctgtctcagaaaaaaaaaaaaaaaagacatctaatttgttgtaaaacctgtcaagaaccttccctttaaaaagctaatgcctctctaataaaaataattttaattttgttgtaattaaattcagagaggatgatgttagtgcacaaaataaagattgtcaatttctttattttaatccaacggcatttcctaactgcaggaggcccaggaccgttggcagaaattttgtgttgattagagcctcgggccatgggaagtgcaggtactgtggccacaaagttcgtcgcccaatccctggctgaccccacaagcaggactggtacagatcccaccctcaggggtcttcctacacagagaaacataatcacacaggtgactggaacggagccaaggatggtggtgttcctcctagggatttactaacactgccagcaactcaagaactagccagccgggagtttcctagtaagtgaaactgacttggttctgcttcctttcatgaaaacctttgtgaaaatgagcccaataaggggtccgaacctttataaagcacacgaccccccagagtggaccgggccctggccgactccatcagccgaagcttgagatcttggatggtctggatggtcttgaccgtgtgtgattgatgcagttaacaaagcaggaaattaacagagcttactctgagacaccagggaagtggcttgttctttcttggggttactttgagtggatgctggcacactgcttgttttcttatagatacctttctattgggctgtgtttattcaataaggaaatgcagttaacatttttttaacaagtaaaccatgggttatgaggtgttccgagtttggttaagggaaaaacaaattgacaaattagctctttcttaagtgagtattgcgaaacagtgagaaatagaatgcctgtcgtaccgtcattaaaaatttatctgggtgttgacagctttttgttaaatgtaagacattcagatcctgtccacccagcatatgaaaaaaccaaaccaaaccaaaccgaaaaacaaaatgcaacacaaaagcttctttccatttccccccaaaagcaagacaatttttcttaaactggggctttctccctaatgaattgccatgattttgttttctctaacatagtttaatatctttaagacagaacgaatatcaactctttttattttattttttgagacggagtctcactctgtcgcccagcctggagtgcagtggcacaaactccgctcaccgcaacctccacctcccaggttcaagtgattctcgtgcctcagcccccccgagtagctgtgattacaggtgtgcaccaccacgcccagctaatttttgtgtttttagtagagacagggtttcaccatgttggccaggctggtttcaaactcctgacctcaagcaatccacccccttcggcctcccaaagtggtgggattacaggtgtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatggagacttaaaatagcagtggcttcccgcctagagggcggacaggactggcaggacgaggctgggatggatggagcagtgtgtctgagcctctgggaaggctgcaggaagggcttggaaggcgggtcggggagtgggcagggggcgcccactgagttctgtgtgcttggggaggtgtgggagacagggctttccagcagaacagtcgtggggtggccggggatctctagggctcccctctgagcttgggttccctccctctgccctgattatcccttgggtacccaccacaccatcgccacacaggcccccactctctgccttgtgtgtccgatttaggactcattcagctggttaagaatgcaaaattaattcttttttttaatatagtgaaagcaggtagattatattaaaatggctgtgttttgaaagctactgataggtacacctatggaatagatgtttctttttcagtcccattaattatctttctgtgcaaagtaacataagtgttactttttcagtcccattaattatctttctttgcaaagtaacataagtgttggttaaaatacagttgacccttgaacaacatggggattaggggctgatcccttctgctgttccccctaccccacctgcacagtcaaaaatccacgtataactttttttctcccctcccctccttctcttctcttctcttctcttctcttctcttctcttctcttctcttcttttcttttcttttcctttcccttccttttcagacggggtctcattctgtcacccaggttagagtgcagtgacataatcatagctgactgcagcctggacatccggggctcaagcagtcctcccacatcagcctcccagtagctggaactacagacactcaccagcatgcctggctaatttttaatttttttctttttttagagacagggtcttgctttgttgcccaggctggtcttgagctcctgggttcaagtaatcttcctgtcccagcctcctaaagagctgagattataggcatgagccaccaggcccacataaaacttttcattccccaaaaacttaattactaatagcctaccgctgatgggaagccttaccgataacataaacagttgcttaacatgtattttgtatgttaatatgtgtgatatactgtattcttagaatgaagtaagctaaagaaaatgttattaagaaagttgtaaggaagagagaatatatttactaatcagaatatagaatggatcatcataaaggtcctcattctctttgccttcatgttgaggagtctgaggaggaagaggaggcgttggtcttgttgtttcaaggtggtggagatggaagggctggagcaggtggagggggagtcgggagaagcaggcccaattggtataacttgttttttttttttttttttttgagatgggagttttaccctgtcacccaggctggagtgcggtggcggatctcgactcactgcaaccttcgcctcccaggttcaagtgattctcctgcctcagcctcctgagtagctgggactacaggcacccactactacacccagctaatttttatagtagagatgggtttcaccgtgttggccaggttggtctcagaattcctgacctcagatgatctgtccgcttcggcctcccaaagtgctgggatgacgggtgggagccaccatacccagccccactcaatgtcacttttattatggaaaaaaaaaaatctgcgtgtaagtggccccacacagttcaaacctgtgttgttcaagagtcagctatatgtataattgtacctgtggcacatagaacacaaaaagatccacatttttaaaaacagcattgggcagaacaattttttgacagaggtctgtttgactctgctgacagcctgagtgggaggaaacttccccatatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcctcttcatttagtctaagaaactacctaggatatttttgtagaggtgacatcactgtctggctgcagaagcatttgcttggatttggggaagtgagggctgggagaggagggcttagagaggcaggatgcccaggcccattgcgggtggctgatggggggtgggcttagcatctgcagggacagggtggagggagaggagccaccccaggcagggggaaggggtgtgccccctttgggatatggaggttttggggggctggtgggagggaattccaggggtcgagcccctggggaaaaggaggctttaaggtcagtggaaaagtgggtgccaaagtctggaagatgagttgaaacctggagtttgaagcccggggaggattttgttggagtgttggctggtgctggagagttttgcatcacttggggtggggtggggtgaagaattaacttgaactggcacagcacccctttgtcttgactttccctgttctggagtgaggacggcttgatgtttcagcaaaaggagtagtggagagggagaatatttgcttgtaggattgggttccacataccatatctacagttttacatccactggtgacaagacaggagcttttctatttttgttttgtatttttatgtttttgtgcactaacagtaatggtttcatgggaacagatggcggacggacacgggcttaggctcttggtttatttcatgttacttgcatgacagccctatggagctgcgtacctgccataggtgagaagccgggagttggggttacatcccggactttgctgagctccaggagtgtttttcctcccgacctgcgctgttccctagacaaccctcagccgaagcagtggggtcatcgggtgactcagaagggacctcttctcaggggccgcccaagatgagcttggctgggtctgggtcacttagcagtgagcagcaggggatggaaatggggccggggtgggtgggcttgaggggagcactttctcagggacgcctggctggagccttgccctggcaagacttcaaactcagccccgcagagaagggtcatctgatgatagaatcacggctgccccatcattcccattagcaaacttcatctgatagttggggtacggttgtggctcaggctgtaaggagcccccctgttgcattactcactatcctcagatgccccatccttgcctgaagcaagtttgttgggacagttttggggaactgttaggagagaggcctggtcatggggccggaggggcccagaggagcggcctgccctatctgtgggcggttcggtgagtgctagatggggtgtctctttacaagactttcctctgagatgctggggctatgcccctgggtgctggggagtgaattgcccgtagatactgatacctgtacttaaccctgtgacggtcaagaccagatccccactctccaagcccctgggaaactggttgatgtagcccctgcagtgataccgcactcaaatccatgcagatcccctgacatggtcggggcagcacccaccacgcaggcttctgttctgagctacatgggatgttgggcgtgtgttttctaagagactgatttcataagacatgtaccagtggccgactggcctgaaacagcctggtcacagcgacatccctgagatcttagcttcttttcctcggggaattatcattggactggaaaactgaggttttgggccactctggattcagatgcttttgttgttgttgttttgagacagggtcttgatctgttgtggactgcagtggtgggatcatagctctctgcaaccgcgaactcccaggctcaagtgatcctcctgcctcagcctcctttgtagctgggaccacaggtgtgccccaccatgcctggctaattttttttacatatttttatacaaacagggtcttagtatgttggccaggctggtctcaaactcctaggctcaagtgatcctcctgcctcagcctcccaaagtgccgggattatataagcgtgagccaccacgcctggcccagataactcttgcctgcctgatttttttataatgatgcactttgttttgttaaaaatttataaatttaaagacaaaatatgcaaaaatgtgccctggtctcagaaataacacagcacattcgagtgaagttgttggcagttccgtgtgttttggggtgattcatttttttcataggttgttggggccgtgcatccattcgtgttctgagcacactccatggtacctgatgactcgaatggatcctgttcaagcccctgggttacccaaagaaatatacttctggcctgctggttggtcagagaatgcaggacacattggggtatcgcgaggtgtccaatggcagcgggttgggtgtgtctgctgtgtgaacagggcaggggtttgggaagatggactctggctgtcttgctccaaagacttccttaggctgttgttgagcatttattgagtgtctcctgtgtgccgggcagcattctagcatagggattgagtgaccagacagtagggaatccttgcccttaaggaactgacattcttttttttttttcgagatggagtcttgctttgtcgtccaggctaaagtgcagtggtgcaatctcggctcactgcaacctctgcttcctgggttcaagtgattctcctgtctcagcctcctgaatggttgggattacaggtgtgcaccaccacgccgggctaattttctgtatttttagtagaggcggggttttgccatgttggcctggctggtctcgaactcctgacctcaggtgatccacccacgtcagcctcccaaagtgctgggattacagccgtgagccaccatgcctggccggaactgacattcttgcaagggggatggaagacaaaggcaaggaataagtgagtgcccagtggcctgggaacagacggagcaggactgatacacaaagccccacagagtcacttctgtcttctgaaggccctgagaaataactttattattattattattattatttagagacagagtctcgctctgtcgcccaggctccagtacagtggtgtgattatagctcactgcagctttgacctcccgggctcaagctatcctcccacctcaggttcccgagtagctggaattacaggcatgcgccaccatgccaggctaacttttttgtattttttgtagagatgggggggtctcactgtgttgcccaggctggtcttgaactcctggcctcaggcgatcctcctgccttagcctccgaaagtgctgggattccaggcctgagctgccatgcctagccccgatttttaaactgaagagggatggttcagttgttggggtgtgtcttagaggatccttctggaagccccacatggaaggcgggctagagtgaggagggaggggtgataatggaaccaggagggtgtggtggtcatggcccagtgagaggatgccaggctgtggccgtgccagactcagtgtgcctggccctggcatttcaggcagggaccactgaggggtgatgggagagatggggctgggtgagtggcatttccacaggcatccagaggggtgcgaaaaactgaggttggggaacagcaggggcagggaacagcctgtggagggtgtggtcatcagtgtcccccaccgacatggcacatccagcgagcccactgtgtccccagcacctgcggtgcagggggctggcaccttcaggggcgggcttcgtgcagacgtccacccagtcagtccccacaggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcctgggtgacagagcaagaggaagactctgtctcttaaaaaaaaaaaaaaaaaaaaaaaagaatccaaaagcaagcttatggagaagggagaaagtgcgacagtcacctcggggcgtgggagagcagaagatggatgtcaggttaaaaaccattactgtgctgtagtatttccaggaggccaagtccagggctctgggacctgtacactgcggcatcagaccctaaaacagagctctcaggttttcgccttcccaggaagtctgcatcctttttgcagactggttttattctgtgttaggaggaggcgattttgctaagaaatcttcactgcaattttcccccccaaatcagggcacttggcatctccttctaacggggggtgcagagtctgtcctagaatgggacgcacagtgttcacacgagtaccgagtaggtggggtgctgggccggcccctctgatcctgtcctaccctgtgcagccacgtgcctttccttatccccagacttctgttgtcacgattcttccagggaagaatctggaagtggaatccacagggcggtgcccagggatggcctttagtgcctagtgttctgtttcagagagaggcctcttatttatttgaaaagctgattgtttcttttttttttttttttttttttttttgagatggagtctccctctgttgcccaggctggagtgcagtggcactatctcagcccactgcaacctccgcctcctgggttcaagcgattctcccgcctcagcctcccgagtagctgggactacagacacccgccaccacgcccagctaatttttgtatttttagtagagatggggtttcgccatgttgcccaggctggtctggaactcctgacctcaggtgatctacctgccttggcctcccaaatgctgggattacaggcatgagccaccacgcccagccttattttctatttttaaagaaagagcaagactgaaaacatttgcatgcacagtgagttttaaaaagttcctttttttagagaggaccaagaaggtgcagagtactcttgaaaagaaattttttttctgttctaaacgtgccgcttgttgccctggtgcagagagcagttcttttgatacaatacctccgtcccgtaacttttttttaaagctaaaattcatataatgtaacatttacctttccaaagtttaaaattctggccaggcctgtaatcccagcactttgggatgctgaagcgggcagaccacttgaagccagaagtttgagatcagcctggccaacatggcaaaaccctgtccctactaaaaatacaaaaattagccaggtgtggtgagcgcttgtaatcccagctactcaggaggctgaggcaggagaatctcttgaacccgggaggcagaggttgcggtgagccaagatctcgccactgcactccagcctgggtgacagagcgagactctgtgtcataaataaataaataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtccaattatacacttttagttattttatttgtttgtttattttgagttggagtttcactgttgttgcccaggctggagtgcaatggcgcgatcttggctcactgcaatctccatctcccgggttcaagcgattctcctgcctcagcctcctgagtagctgggactacagctgccatgcctggctaatttttgtatttttagtagagacgaggtttcaccatgttggccaagctggtctcgaattcctgacctcaggtgacccacccacctggcctcccaaagtgctgggattacaggcgcgagccaccgcgcccagttgcttttagttactttaaaatgtacgattaaattatgatcgactatagtcaccctgttgtgctgtcaaatactaggccttattcattgattctatttttttgtagccattagccgtcgctacctccctgcattgttgcattttggcctcttatgtgtaagtcccgtttgttctccagaatgctgcttttaacacccagcccgttccatctctctctcttctgccttgggtgtcatgctgtctcttcctcagatttctcctggggtgcaggtgctcccctgcgaaccactgctgtgcacaaagtgattttgtgctcaggcaggtggatcgcttgagcccaggagtttgaaaccaccctgggcaatacagtgagaccccatctctacaaaaaaaatggctgttgtgcagtttgggatgagagttggttgcccccgcggtcctcccttcccccaaccccacctgccctccttgctcagcaacaagggacccccttcactggactatgaagcctgagggttgtctaaatcaatccttggccaggcgcagtggctcatgcctgtaatcccaacactttgggaggccaaggcgggtgcatcacctgaggtcaggagttcgagaccagcctggccaaggctctgagagcagcgagactccttctcaaaaaaaaaaaaaaaaaaaaaagaatcctggctgttccttccccacggccagtgggcattacactttgttttggctggagaaaccgggagtgcccgttgtctgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatagtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtcaaaaaaaaaaaaaaaaaaaaaaaaaaaaaaggataccaaaattctcaagtcaaattataagggttttaacattcccatttctacaccacgtgcaagaaaaacaaaatccttgttttctgcctgcctttatggtccgttctcattttcagccccctttcctcattctactctattaattatgcctttatatggatgcaaacttgtaaaatatgtggcctattttgtgtgtatacgtggttttaattcataagtgtggcactgtgccctaaatctttttctccttccttttcactcgtcacatttttttttttttttaaatgacacagagtctcgctctgtcgcccaggctggagtgcagtggcacaatctcggctcactgcaacctacgcctcctggatttaagtgattctcttgccccagcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcaccctcggtggtatctgacccccctcccccaagcccctccatgcacagcactgctaggaacgttcttacacacgtcccttaccagtatccaggaaaagccttgctggatccagccagatagtggtccttctttcacgaagcacctccagatcgcttcccagcgtggctgccccacttactcccccacccacagtcgtgagagtttctttcccccacaatctcatccgtgctttgtggagatattttttgccagtgagatggttttaaagtggtacttcagtgttgtgtcattttctctgatcaccagggaagtcgatctttgcgataagcctcattttatacttgtcagcttttcagatttcgccttttgtaaattgtctggtcatatattttgtcctctttttttttttctaaatggtttaccatctttttgttgatttgcaagagctccttgtatgtttcacatgcgaataatttgtcaattttctttcttttttttgttttttgagacagagtttgctcttgttgcccaggctggagtacaatggcgcggtcttggctcacttcagcctctgccacctgggttcaagcgattctcctggctcagcctccccagtagctgggattacaggcatgcgccaccacacctggctaatttttgtatttttagtacagatggggtttcaccatgttggtcaggctgatctcaaactcctgacctcaggtgatccgtctgcctcggcctctcaaagtgctgggattagaggcgtaagccaccacgctggccgttatagttttttaaattaaaaaaatttaaaattctaatagattattgtggtatagaggaaacaattggtttttgttgatttcgaagctgggaagcttgctgttaatatttttactaattaacttgattctgttgcattttctctggaaataatatatgcaaaataatgcaagtttttatttgttcctttccttctgattcttacagtggagtgacttgctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctcccatttctacattctgtatttctgaatttatttacaactcttctctttatttttagttgtacatagaggtttgtttatcttactgatcttgaaaaaacagcttttggtcttgttaatcttgccttttttttatgtggcttatttctcaccattattttactttctgagtgcattttttttctaacttatttttttgaatactcagctttttatttcattttatttatttatttatttatttatttttgagacagcctcactctgtcacccaggctggaaggcagtggtgtgatcttggctcactgcagcctctgcctcccgggttcaagtgatcctcccacctcagtctcctgagtagctgggagtataggcgtccctgccaccacgcccagctgagttttgtatttttagtagagacagggtttcaccttgttggacaggctggtcttgaactcctgaccttgcatgagccacccacctcagcctcccaaagtgctgggattacaggcatgagccaccactcctggccttgaatactcagctttttaaattggggttctttcttgttttggataaatctattcaaaactgtaacatttctgctaagtattattttagctgtgttccacaaattttgacatgtagtgctttcatttttattcattttgtaattttctattcattttgtaatttcccttataattttctctttaacctaagggttatttaatactgtatattttttagatttttgacacttttctttaatggcttttaaaaatgttgttgctgtcatttttatcacatatggtcagagaacatagttcacataatcctggttctttggaatctatgaggtcttctttttggtgtcttgcacatggtggatttttgtgaattttccatatgtgctcaaaaagaatgtgttttttgagtagaaaaaaacgttatatatgcagtatacaagtgacatataccatatagtcatacagtttgtttggtatatggaatacattcatgtcactgtttctttgataattttcttcccatagttttttttcttctttctttctttgagacagagtctcgctgcatcacccaggctggcacgcagtggcgtgatctctgctcactgcaacctctgcctcccaggatcaagcaattcttgtgcctcagcctcccaagaagcgagaattacaggagcacatcaccatgcccagctaattttcctagttttagtagactgggtttcattatgttgctcaggctggtctttaactcccggactcaagtgatcctcttgcctcagcctcccaaagtgttgggattacaggtgtgagccaccatgctgggccttcctacagtttttgacagttgttacattatattaggttaaggctgtactgttacattgcatgtatgatcatgatcatgatctttagattttcctgatgtattggttttttttttttgatgtctgtatagactcttattatgtttttcatgttaaattctattcgttttgacattaaaattattctattttttttttttttttttgagacagagtctctctctgtcgcccaggctggagtgcagtggcgcgatctcggctcactccacctcccgggttcacaccattctcctgcctcagcctcctgagtagctgggactacaggcgcccaccaccacacccagctaattttttgtattttttagtacagacggagtttcaccgtgttagccaggatggtctcgatctcctgacctcatgatccgcccatctcagcctcccaaagtgctgggattacaggcgtgagccaccgtgcctggcctattctcctattttttttgtttgtttttggtttccatttgtttgatgttgctttttctctttaattatttccaatccatatcattttgctttcattgcatttgttgcagatctgtgatgtaagatcttgtttttaaaacccaggttgagaatctttgataagtgaatttagctgagacacatttctggtagttgtgttatattaggatttctgccatcttattttgtgttttctgcttaccattacttatttttaaaaaagcttttcttgtaatgctttgtagggttgaactttcttctgctggattttaaagttgtgcaatctattttattcttctagagctcagaattgtgattattcttaaaattattaagagccacttatgtgattagtttttcctatccatttcttttttttttcttttagaatataattgatttttaaattcacttacttgtttcaactgcctggagtagggattcctgtcagtttctaaaggctattaatatctttgtctttctgtcaaacaagttaagtgatagggacctcgtttcctcccttcagcctgttgagatcgtttagattctaggataatggtgccatataggactgtggccctcgggtgtgcagaatcagcgtcaccaggtattagactttcagtattaatgttctctccttgctagaatatgtgaacaaatgtgaaccttttgaaagagccaatccttcaggatggatccagaatggctaaccaggcctaaatctaaaatagagccagacggccatttgcagattggaagtcacacacttagtctgagttccctgaaaacctgcacctttcttaagtttgggactttcagagctcacctgacccaactagtctgagttcaccagccctggccaatcagggctcagctgtgtcaaccaatcagccctaagcacgtttgaatcattcataaagaaatctgactgggaacctgggtgggcactgttgctattaacaaacaccgtccccctccccgcccccgcccccgcccccaaccccagcagcttctgtttacacggaaggctgcatctccctggtttgcacgttgtccacgggaataaagtctctttcctccagattccttttcagagcacttttgttaagtattttaaatgatagtgcatttaaagaagtctttctgtgataaacttcctgagactttaaagtctgagtctatacttattccaccctcatatttaagtgatacattagctggatgtaaaattgtaggtcaaaattctttttcttcaacacccagattattcccctgttttctttttgcacagagagtcacggttgagaaatatgaggacagtgtgattcttactgctttggagggaagtctggtttttctttttatccctgtcttcattcttttttctttttatccttgtcatcgttcttcttttttctttttgtttttccgagacagtctctctctctgtcgcccaggctggagtgcagcagcacgatcttggctcactgcaacctccgcctcccgggttcaagtgattcttgtgcctcagccttttgagtagctgggattacaggcgcctgcccccatgcccggctaatttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggccccaccccaggcctcctgagacagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctttttttttttttgagataggctgttgctccattgcccaggcaggagtgcagtggtgcaatcctagctcactgcagcctcgacctcctgggatcaagcgatcctcccaccacagcctcccacctaagccccctgagtagctgggactacaggtgtgtgccaccacacccagctgattttattttttgtattttttgtaaaggcgatgttgttcaggctggtcttgaactctttggcctcagcgattctcccacctcagcttcccaaagtgctaggattgccagcgggagccaccctacccagccgaactcctttcttacacgtagttctgacagtatcgatcatccactcttcaaggtgctaatacattaaaacagcaaattggaagtaggccaaggaggtgctagtggcagccccacggacagtagcaattaagaccagttgctagcttgatagtgggagaccagaaagactaaaaataattgcaggctgtgttggtctggtatggatgctgacttcctgacatgtagctaggtggagtggctcatgctgtaatcccagcactttgggaatccaaagtgagacgataacttgaggccaggaattcaagagcagcctgggcaacatagcaagaccctgtctctacaaaaaaatttaaaaaattaaaaaaaattagctgacatggtggcacgcacctgtaagtctcagctactgaggaggccgagatgggaggatcgctggagcccaggagttcgcggctgcagcaagctgtcattctaccactgcactctaggttgggcaacagagcaaggtcctatccctaaagaaatgacaaaataaacagtcaaccacctggtggagaaggtagtattttcaccaacgctgtagcaaatgtcaaggccaagacaaacacttgtttggaaaatttagttttggggaaactcctctcctctagtgtgctggattcatgatatattgttacctggaaatggcagccctcagtggataagaacctggggttttggagatgacccatgtttggcggcacctgatccctatcagcagccatgcgtcccactgtctaggcagtggccaagggtgctctgtcttggacggcagacagcacatctgatttggaatttttgttccagcacttcttagctgtgtgactttgggcactgctgaacctgcttcctccgtgaaacagccagtgataaaactatttactgtgtagaggattctgtgagactcaacgtatggcagtgcctgatgtactattctaaatttatttttatttttattttagagatggggtcttgctgtgttgcccaggctggtcttgaacccctggcctcaggtgatcctctggcctcagcctcccaaagtgctttttcattttctcctcaaaatgagaaagtaaagtgttatggtgttggcagctcacccatagaaactgctttaaaggccaggcatggtggctcatgcctgtaatcccagcactttgggaggccaaggcaggcagatcacctgagatcaggagttcaagaccagcctggccaacgtggtgaaacccatctctacaaaaataagctgggcatgatggcgggtgcctgtaatcccagctactcaggaggctgaggcgggagaatcacttgaacccgggagccagaggttgcagtgagccaagatcacgccattgcactccagcctgggcaacagagcaagactcaaaaaaaaaaaaaaaaaaaaaaaagaaaagaaaaaataaactgctttatattaaaagaaaaataatggtcataatctggccttaggggctatagcatcaatggtgaggcctagatcgcccaggtcactgggtgtgtattgacgttgtttacatgttttatttcttttatgctttttcccagagattgatttttttttctcccttatgtgattcaaaatatctgcttacacgttaaacccagctcagttggcataatgtctttttaaggcacaagccagcttcctgggtgtgagcagcttccacatcaaatgttcagtgggcaaatgaaacatgtgagtcacacaacacttggcacctctgtggcttttaatatttggtggcaaacttcctaccgcgaggagaaaattttcaaagtggaagtcctttcagatccagatggcaaaagaatttgttgggcgagggatcttgattcttaatgttgaggggactaggaatgtttgaattttctcccccttgtattttcccagcctggtaggcctccatgggggccaaatttagttgcgaatttgcccacttttgtgcagagtgaggctccatctatggaatgtgcttaaccataaggatcagaaaaatttctagtagctttgttaagtgcacagcaaacagaagacaaagtgtggccgggtgcggtggtttatgcctgtagtgcaagcacttagggaggcagagatgggaggattgttgagcccaggatttcaagacccagcctgggcaacatagcaagacccccttctccaggaaacggaaaaaaaaaaagagtttgaaaaaagtgtgtagactaactgaacacttgcaaggcaattttttttttttttgactgtctggagagcttgggttccatgaacacaatacagctcttgttccacgtgacttacaagttgggccccgggttttgttttcttggccgagatcttgaagactgtctccaagtaggtgtttcttccttggcagcaggtttggccagttatgtagtcagccctgtccttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggctggtctcaaactcctgacctcaggtgatccgcctgccttggcctcccaaagtgctgggattacaagtgtgagccaccatgcctggtttatttcattttaaaatgcaatttttctgaaggtagtcattgtttttgcatgttttcttttcttcaaaacatttttcatttgttaatcaacattttataaggcttaatattaaaaaagaaccaaccccaccccacttctccccactctcatttcctacacccaagagcagccctggttttctttttctttctttctttcttttttttttttttttttttgagacagggtctctctttgttgtccaggctggaattgccgtggtgcgatcatggctcgctgcagccttgaccaggtataggaaatgagagcactgtgcccggctaattgttgtattttttgtagagatggcatctcaccatgttacccaggtggtctcgaactcctgggctcaagcaatcctcccgcctccgcctcccaaaaagctgggattacaggcatgagccattgtgcccagccagcccctggttttctaagtagcaggcttataccacttgtctttgatatttcagtgttaggtgttgacttactgatgtgttttatgagacatggatgaggattctggcctcagaaaaggctgcctacgcctctctctttctcagaatagtcacatttcacctgtaattccagtgctttggaaggccgagacaaaaggatcaccggaggccaggagctcttgactagcctcggcaacattgcaaaactctgtctctaccaaaataattaaaaataaaaaaattatccaggtgtggtggtgtgcacctgtaagtcccagctacatgggtagctggggtgggaggattgcttaagctggggaggtcaaggatgcagtgagctatgaccacacccctgtactccagcctgggtgacagagcgagagtctgtctcttagaaaataacaaataaatacatttttaaaagcatagtcatacttctctttttggctcaatcaattttcaaatatacagtgtttccatagctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgcatcttattttagatttccaagttttcttattctttgaacatttttatggtctgttctttcatggaagcatcatcttttatattcctggctacattcatcacagttttttaaaaagtttttggccaggcaaggtggctcatgcctgtaatcccagcactttgggaggccaaggtgggctgattgcttgagcccaggagtttgagaccaacctgggcaacatggcaaaaccctgtctctactaaaaagacaacaattagctgggcatcgtggcacacacctgtagtcccagctacttgggtagccgaggtgggaggatggcttgaacactgaaggtggaggttgcagtgagccgagatcacaccactgtactccagcctgggcgacagagcaagaacctgttgcaacaaataaaaaaattttaaaaaagttttcttctgttctctgcgttggaattttttttttttttttttttttttttgagatgaggtttcactcttgttgcccatgctggagtgcaatggagtgatcttggttcactgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcattttgcacacctgcccggcctccaagtcctgcagctcgaatgagcttgcttgctgcaggcggcctgctccatcttgaggcttgtctggaaaggcggcttcggctttccagtgctttccagcgctttccagcttctgagattttgggggcttttcatttgttcttgctttcctgtcctctttgtcaggtgagtttatacctttctgttccaaagcaaacaggatcgtctgccatgttgaactggatgtcggacaattctgaaatgtgtgcatggggcaaggctgtgtgtgatgataccagtttcataggaaacacttcggttttggttttgtctttcaaagtcatcttttgtgagcgccttctagccgggctgccagcgggtaacatatgattaacacaagtttggagtctgtctgcagagcaactttatgaaatgctcagaaagccagtctcctaagcataggagcctgtttggtggtgatgggatgaggaagcagtgggggctttggcaccagaggcctgggctcaaatcctgcctccatcatttaggggttgggcatctccattcccttatctctgggtggcgagaacttcctaagttcttagtgtttggaagggaccccctccataaagtgaggtgcctcttggccactgctcagccagtgggggctgttcctaacagttgcctcctccgattgctggagtaagaaatgacaccctgtctcccatttctgtggcaccccattctcaacagtgatggttctgcctgtttttagtcacacacacctgcacacttcaaaggactaaaaatggactcagttttctttctttttttttctttttgagatgaagtctcactctatcacccaggctggagtgcagtggcatcatcttggctcactgcaacctccgcctcctgggttcaagcgattcttgtgcctcagcctcccaagtagctgggactacaggcatgtgccaccacacccagctaattttgtatttttagtagaggtggggtttcaccaggctggtctcaaactcctgacctcaagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctggccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttctccagggtgctggggacccaagaaatgcctggtcgtttctcataggttgataaggaaaatgaggcctaggtagggacaggcaggatttcacctgaatttacaagatgatgcaatggaagagtcttcagtatattttcacgtattttagaattgagttacaacattcattttggtactttctctgtgttctccccatgtgttaaaaagcagcttaaggccgggcgcggtggctcatgcctgtaatcccagcactttgggaggtcaaggcgggtggatcacgaggtcaggaattccagaccagcctggccaacatggtgaaaccccgtctctactaaaaatacaaaaattagctgggcgcagtggcagacgcctgtaatcccagctactcgggaggctgaggcaggggaatcgcttgaacccgagaggcggaggttgcagtgagccaagattgtgccattgcactccagcctgggcggtagaaggagtttccagctcaaaaaaaaaaaaaaaaatgcagcttaagtgctggtttagcgcctgtaatcccagcacgttgggaggctgaggcgggaggatcacttgagcccaggagtttgtgactagcctgggcaacatagcaagaacccgtctgtacaaaaaataagaaaaattggccaggtgtggtggcgtgcatctgtagtctcagctccttgggggctgaggctgaaggatcgcttgagtccagcaggaggtcaaggctgcagtgagctatgatcaagccattgcactccagtctgggtgacagagtgagaccctgtctcaaaaaaaaaaaaaaaaaaaaaaaaggaaacaagaaagaaaaaagcagctaaattctgctggaagtgtgcagtaaagcacaagttttcagccatcaacgcagggagccgttaatcacgacccataataaccagaatgttattccacggttgcggtttgtttatttcatcagagttgcgtcttcacctatttccctccctactcttaattgtttatccaagttagtgttttccattctttcactgaaggctctaaaaatggtcccatcaagaagtctggtagataatggaagacgaagtggactttacagaaagatgaattttcttccctagagctggaaaacccttcagcgtgtcatgcgttccccagccaggacagacaaagccacgcaatctgtttcctgcaggcccagaggggaaggcttcctccttgtggttagtgacttcaaaagctgtcctcactagagcaagtccaactcttcctctagttctgatgacttcacggcagccaactgagctgctgaacgctgtttttttctacgcagaaaccctcccgactttcacgaggagttgacaggttttcctcttcactcgggctcccttgtcatcgttaaactgaaactgctttcttgtagccaaattctgtggtcccttttcggcctcggcctccttgacctctctgtgtccccaccttggctctcccacgcctgccagccgtaccacaggccccgggtgtgaaccctccctccgcggtcatgcagccacgcctctgctcaagctgtgcctcctcctgggcgcaccctccctctcccatccttcagcctctgaagtcctgcccagctccggttcctgtttctgttaggacgaggcccttcagatcctctccagcaggtggactctgtcctgccccgtaccacccgccgcgggccacttttgggcctgcgccatgttcctgcccttaccccgcccggtgttagcgtcacgtgggtcctgatgtcctccctctcccaggcctctgcttatctgattgggggctgtgcttgactctgaaacccgggcacctcctacagggcattttgcctgtcacaggcctagcattcaatacctatcatatttttgaaatatctgcagaaataaaaagaaataactattttcttcttcaggagttaagatgcgtggccaccaagtacttttcaatacataaaatatgttttcagcacagaaaggcctttcaccgctcttacttacatagtctgcttttggtatgatggggacggatgaaaaatgaggactgtaggcctccgaagtcagctgttttgaattaaagcagcgcacgctttgagtcaggtgaagcgaggatggggtttcacccgttgaggatgaatttgctgggttactttaaactggaactgttcttttcagaaatgagtgaagcaggaagggaaagacggagcttgtctggctgggtcggatgaccccctttgccaggccgtcacccctctaggttgagttagctcagaataacttagctgtgctatagctttgcataattgcaaggagctttgtttcgttttattttgcagggaatttttttccccccttagctcttcctcctggtgtatttgtagaaatcagcttcatcatggtcatttaacagtaagggctgggggtggtggctcacgcctgtaatcccagcactttgggaggccgaagtgggaggatcacttgaggtcaggagttcaagaccagcctggccaacatggtgaaaccccgtctctactaaaaatacaaaaattagccgaatgtggtggcacgcacctgtactcccagctcctcgggaggctgaggcaggagaatcacttgaacccaggaggcggaggttacagtgagccaagatggtgccactgcactccaacctgggcaacagagcgagactctgtctcaaaaaaagagaaaacagaacatactatttttgttgtttctgaggagtagggtttcttaccagggaacctgctttaaaaaaatgcagtatgtagattccttaagaataaagttaagcagcagctaaccaagcacatggctaaaaacccggccaagagcattgtagtatctggttttggggttggtggtggggatcccattttagaggccgactttggtttgtgatggttaggttttactttcttaggtctcagctcacatgtccccttctcagaggagccatcctcacccatcccttcttggtccctcccgccttccctgactttttcttcttcaatgacttatctgcacatgatcccctacttataaaacctgtgtcttccactcctctcacccgaaagaatgtttgaattctgaaaacaatgactttgttcttagcacccacaacagcaaatgctcagtgagccctatgttgagtgagttagttgtgagctgtggtggtttagtgagggtatactttggcccttagaatgcgaatgccttttttttttttttttttttttgagatggcgtcttgctctgtggcccaggctggagtgcagtggcacgatcttagctcactgcaacctccgcctcccaggttcgagagattctcctgcttcagcctcctgagtagctgggattacacacactcgctaccatgctcggctaatttttatatttttagtagagactaggtttcgccatgttggccaggctggactcaaactcctgacctcaggtgatccgcttccctcggtctcccagggaatggctgtttaatcacaagaaagtcttcccttcatgcgttgtgaaaaccagcagtattttaattgaagaaatccggtattgtttggctttctagatttggaagtaggtcaggtggctaatgattgaaaatggaccggcaaccagagggcctttggaaactctagctcgacttcaggctatagttttgtttatgcccttgtcactaaaggcactgcccatgagagctgggtttgcagtccctgctgagcctggggttgagagcagagccctagagtaactcagcaaaggcatccctccctgcacctgagctgggggagaggcggcttatgattaactcagcgatgtctcaaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttcccagccagaaggcttcatgggtagtatctttaagatcctagcagaaggttgcttttctctctctctctctctcagtcctttctttttctcttttctttgcttctttccttctttcctttttctttcttttctttcttctctttctttctcttttcttggcttatttccttctttcctttgtctttctttgctccttccttccttccttttcttccttcccctttctttttccttccctccctccctccctaccttcctcccttccttccttcctctctctttctgtctctctgtctctgcctgctttttcctctctctctctgtctctccccccttctcccctctcctatcctcttcttccttttttctttttttggaaggcccagattagtagcagagactctccttgaaggggatagatgcattgtcgctgtttggtattttgaacagattcttaagaaaatgttttcctggtggaagatttcagacacacatgaggtgagaataatgaaccctgtgtgctgcccccagcatgatcagttccaaactattggcctgtctagtttcatctccgcccctgcctactcctggaattttgaaaaggacatcatattattttctccataaatatttcagtatgtatctctaaaagataatgtcacttcgaaaaaaatacctaataccacgatcacacctaaaacataaatgaacaatatgaaggatgagtttctgctgtgtggcatggcagaatgatgctctgtggggtcccaggggagaggtgagctaagttcagtgtgtcacctgctgtcacctgccatcacctgtcccagggcctggggctagccactgctcttttgtgagcctcagtttcttcatctataaaactagaggattgtactagtctgtctgtctttccttcctttcctccctttcctgtcctgtcctgtcctttcctttcctttatcctctctctcttttatctccccttcctcccttccttccttccttccttccttccttccttccttccttccttccttccctccttcccctctcttcttctctctttcctttttttaaagagacagagtcttgttgtgtcacccaggctggagtgcagtggtgcagccatagctcactgcagccttgacctggtagtctcaagtgatcctcccacctcagcctgtgaggttccgggaacacaggtgggcaacaccatgcctggctaatttttaaattttttgtagagacaggctagtcttgaactggcctcaagcgatcctcttgcctcaggcccccaaagtgccgggtttataggctgagccactgcacccggcctgcactagttttttttgtctctagaaatctgcatctctgaatgtgttaggtcctgacctgctttagaacggatctcagccaccctgctccttcgaacccacatttctgccccgtgtctgctggtcgcaggaattggcacattttcctttagctgcgcccaccagtccttgcacgcatactcctggtcacttttttaatgtctggcagatggtttcaagtgcaatggcgtctctgcgtaatagttgattctctaaagaacagagtctactaagtggaagctgcgtttccacatttagcagttagctgttaagagccagtaacaggtgcaaatttgcaacccgttttttccccaatcttttggaatggaaatggttcagtcatttgaatttaacaaactgcctgcccggcatgcactgcagatgctgggctgcaaagctggttttggtgctggttggccccctgggtgcccctgtctactgagggtgggacaggcggaggactgggggctcagtgctgcagaggcacatgtagggtggggtggggtggggtggagaagaagtcctgaccagtcctgatttggtggtgctggtgcttatgggctagtgagatttctgcatgcccaggctggctggtagccatgtgtcagtcactcataatcccagtaccagagttatcatcacccctaacttttttttttttttgagacggagcctcactctgtggcccaggctggagtgcggtggcacgatctcggcttactgcaacctccacctcccggagtctccctctgtggcccaggctggagtgcagtggcacaatctcggctcactacaacctccacctcccgggttcaagcgattctcctgcctcagcctcccacgtagctgggattacaggcgcctgccaccatgcccggcaaatttttatatttttaatagagatggggtttcaccatgttggccaggctggtctcaaactcctgacctcatatgattcgcccaccttggcctcccaaagtgttggggttacaggcatgagccactgtgcccggccacccctaatgttttgatttatttcctttgaatttttttttctctgaataaatggattgatgatatctattgacatagtcagaaactcaagaaacatctatggagcatctagccatggagcagacactcctgttggtctcgggggtgtgtggcgggaaggtcagagtccttctagtcctccaagagcttccagtctggtgggtccctagaatataatacattgtgtgttgtcgtaggcgggacttgcacgctgtgcagttggctttacggttgacaccaggccaccagtggcctcctccgcctgcccttccagcctgcggttgtccttcagctgctgcctgtgaaatgtgatcctttccataagtccccagcacagagactgggaaggcagtttctaagaaggcccttctgttgggctggctcagaacctgccccctttcctctgacttgcctataaaaaggtgggtttttcctcctgcctataaaaaggtgggatttcacactgacataatttacatcgagggacatattaaacctggtgtaatttgcaagtgtgccctgaacacgtttcatcatcaggctcgttgtggagaccacggtgtccctttccttcccatcgtaagtccccggtgtgtgtgtgtgtgtggaaagtttagagctcccaaagtttagagctcagagaggataaagacccgtattactaaacttatcaggaaaatgtggcttcagattattttttttcacagcaataattgcatttcatgtattttttttttttacttattacagaaaatttcaaatatatacccaaacagaagaagatcatgaatgcttttgtgtccatgactcagcttcaataataattatttacttgtcgctggccttgtcttatctgtaactttctcatcgctcacccgacttaaattttgaaacaaatcccagacatcatatcttttgccatccacagatacatcagtgtgtatctctaaaagagaaggactttgcaaaaagtacaaccacaataccattagcacaccctcgaaaaatgacaaagattcatcaatatcagctatccaatatcaaactgccactttcccacaaatgtcataattaaaaaaaaatttgtttcaatcagaacaagaaaatccaagtgagattcaagagtcccgctgggactggttcatgtgtctttgtcttttgagagttcttttttttttttttcttcttttttttttgagatggagtctccttctgtcgcccaggctggagtgcagtggcatgatcttggctcactgcaacctctgcctcttgagttaaagcgattctcctgcctcagcctcccgagtagctgggattataggcatgtgccaccatacccagctaatttttatatttttagtagagacgaggtttcgccatgttggccaggcttgtctcaaactcctggccttaagtgatccacccgcctcggcctcccacagtgtggggattacaggtgtgagccactgcgcccagccagggctctttttatattgcaaaactgaaactctgcacccattaaacaataacactccatttcttccccaccatgccctggcaaccatgattccactttgtctctatgcctttgaccactctaggtccctcgtctaagtggaatcatacagtattgtctttctgtgactggctcagttcacttagcacagtgtcaaagttcctccatgtcgtagcttgtgtcagaatttcctttctttctaaggctgaacaatattccgtggtgtgtgtataccccattttgtgtattcattcatcaatcagtggatgcttgcgttgcttctaccatttggctgtggtgacactgtgtgaactctggtgtgtatatatctcttcaagacccagttttcgtttcttttgagtttatacccaaaagtggaattctgtttgggttgcaccattttaaattcccaccaatggtgcacaagggttccaatttctccacagcctcgccagcatttgtcattttctggattgtttttttttttttggagacaggatctcactgtgttgcccaggctggagtgcagtggcacaatcatggctcactggatccttgacctcctaggctcaatcaatccatccacctcagcctcctgagtagctgggactataggtgtgcaccaccacaccccgctaatttttatatttttttgtagagatggcgtcttgctgtgttgcccaggttggtcttgaactcctgagctcaagcgatcctgctgccttggtctcccaaagtgctggggttataggggtgagccaccatgcctagcctggatttttttcttttttaatggtagacatcttagtgggtttaaggtggtatctcattgtggttttgatttgcatttccctaatagatagttatttttatttttatttaaagggagtctcgctctgtcgcccaggctggggtgcaggggtgctatcttggctcactgcaacctctgcctcctaggttcaagcaattctcctgtctcagcctcccgagtagctgggactacaggcgcacaccaccatgcccagctaatttttatatttttagtagagatgaggtttcaccatattggtcagactggtctcgaactcctgacctcaggtgatccacctgccttggcctcccaaagggctgggattacaggcatgagccactgtgcccagcctaatagatagttatttttaatacttatttaagcttcatgtttcaactgggggtgcttcatgatatattaatatttaatgagccaccttaattatttctaaaaaagtaaaaaagggaaatactatctcccacatggtattattcatgatgtatatcttttttttaaatgttttgtagaatcggaccaaaatcagaccaatcctctcagtttatcacaaagataccaaaacccagagagaatgaggctttgccttagcctcggccctgggagatagaagaggagcctggggcctgggttccccctgccgtggctgcccagtccttccgctgacaccatttcgaggtccccttgtggaacttctgtgggaggccaggtgcacaaagtccggtttgttgagctacagatgcccgccagcagttgctgttattatagactggttgttctgatttgtcaagaaacccagaacaactgtttttcttctttgcagtggatgtgtgtgcacatgaccttttgagaacatatttcctgatgtggtggaggcactgatgttcgtgcagactagctaagttaaatcttcatttctttcagctgaaattgcctggctgctcctttaagaagtgcactgtgtggagttatcatgtttctcatgctgttaaatgtttactggcaatcctgtctactttagcgtattgttgtcaaatgacaagggagtcccctgtcagagagcaatgacacagcctgtacttttgggggcagccagcgtccgagcgtttccacattcattcttacgcagttggtaggctcaggatgtttgtgaacgccgaagggtgtgcgtgcaccctggagtgtggagatactagcatgctatttaatgatggccaccacgggacgtgcgcactcattcattaagctaacgttttatggtttgttgagtgaaagcaggcacaatggtaggtagtgggtactggagcaaatgactgcaccggccctcatgggacttccatttcagtggattcaggggaaagcagcacgtgtttttgagagaccttggcaacgcaggcgaccttgacgtcgaccaaaagaagagagatttggaatgcttgttttacagcctccggtcaaaaaaaatcatatgggaccctttattgcagactggaacatttatttcaaggtctcaaattaaactagaggaggccaggcatggtggctcacacctgtaatcccagcatgttgggaggctgaggtgggaggattgcttgagcccaggaatttgagacctgtttgggcaacatagtgagaccccaatctctactaaaaaaataaaaattaggctgggcatggtggctcacgcctgtaattgctgcactttgggaggctgaggtgggtggatcacttgaggccaggggttcgagaccagcttggccaacatggcgacaccccatctctacttaaaaaaaaaacaaaacaaaaattagctgagtgtggtagtgcacgcctgtatttccagctacttgggaggctgaggaactagaatctcgaacctgggaggtaaaggttgcggtgagccgggattgcaccactgcactccagcctgggtgactgagtgagacgctgtctcaacaagaacaaaaactaaccagttgtggtagcacttgcctgtagtaccagctatttgggaggctgaggtgggaggatcacttgagcacaggagttggaggctgcagtgagtcatgatcataccgtggcattccagcctgggtgacagagcaagaccctgtctcttaaaaaaaagttaaactagagtagataaatgagcaggcatagttgtttgctgatcattcaccgttgagacaatgaacagctcgttaaataaattgttggtaacaatgaaatcaggagaatttcaatcctgagtcagtgtacacaatacaaggcacaaaacgttgagttaaaggtggttctactttgccctctaagcattttattgacttcaaaacctacaaaggcggcgccatggcatataggaatataggaataaggcatataggaataagaagtttcaaaaagtttcataaaagttgtatttggggctgggcatggtggctcacgcctgtaatccctgcgctttgggaggccaaggtgggtggatcacttgaggtcaggagttcgagaccagcctggccaacatggcgaaacgccatctctactaaaaatacaaaaactagccgggcgtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtttcgtaatgtgctcgccctgccccaggcatcaagggaggtgctcactctgtgcactctgaatcccaccaggggcccacctgccaccctgttctcacctgtgaccactcacggcagccacaagaggcacaggtgttaggtctgccccagccacaacacctcagcacgtggtgtgtggcttcaaccaggtcaccgtgggcacactgggaggggagggcttctgtgcggccacgcttaataaacagtctgcctgggaaactgagcatccaaagtgccctctgaaggagcgggatgctgctgcccgtggtggctccgtcacacgcattctggaaggtacctcccggtaagcaacctgatgtttcatctgtcactgttgatgcatctccatgttagagaattaagcatatggaagcaaaacacctcaggaatacagaacgcattcatgatcaccacggaaaatcaaatcaactcaaagtccaaatgcaactttttttttttttctgagacagggtcttgctgtgttgcccaggctggagtgcagtggcacgatctcagctcttagtagagatggggtttcaccatgttggccaggctggtcttgaactcctgacttcaagtgatctgcccgccttggcctcctaaagtgctgggattacaagtatgagccactgtgcctggcctctcttttttaaaaaaaatagagatgaggtctcgctatgttacccaggctggtctcaaactcccggcctcaagcgatcctcttgccttcacctcccaaagtgctttgattacaggcgagcttttctctttttaagccaacttgtgagtagaatcattcacttgtgcctttagctgttgtctctgtgttgaggaatccagagtccagtccttctagacttatctggggacccgagtttccttctgtagagttaaaacctgttgcatccatccccagtccctttacggcacctgtgtaggcctgtagtggagctggcttttgtcctttgctgtccctggctgagccttggcctcatcttgggccagcgcctcctcccctgggctgctgtgatgtgttggcatttcctgggtagagtcttgtacttgctgttttctcctgtctcagtcttttcccccagggacctggcatgtctgtgtgttggggaccctttgctcatcttacacactgaggacaggcaccttagcgcttggtgccctgggatggaacagccactggacagccagccctgtgccctgtgtccactgcaaacctgatcctgttttttggagcccttcacttggcaatgagaccttcatgggtggggttactgaagcaggagttggtttaagttaaataccatcagccgcaaagctcagaatggatgatgaagtgctttaggggttgacagggcagagctggctgtagggagtgatggagagaggctcccaggaggggaaccctctgacgtgggagttaaaggactggggccatttgtcgtggggggatgggagcagtggcttgggaagggacagaacgggagcaagagggccttgcgcactgatgcttttgaggactgaatctgaacgggagagtggggagagggctggaaacctgggcgagaacaggagaggagaggcccctggatgccagcagagctgtaggcatgatctgggccatgccctgggagacgcttccgcaggagatggtgcggctggggtggagacttcctggcttccgagggcgggcgagggggcaaagggcctggggcatggacttgggcaggtagcaaaggccagaaggagtgggagtcattccacctgggatgtgggaatggctggtgggggcaggtagggggagaccaggatgagccccatgtgcgcgtgacctgtggcagaggggctgtgtcagagccccggctggcgagaggagcatcactgtgtccagaggacgcggtgcctttcagaccccttgagtaagagacagagtgggtctgtcctgtctaggctgagttttcattgcccagcacagtgcctggcacacagtaggtgcttaataaacacgtggactgaacacaagaggttgaggggaaaggtcggaattggccacaggtctcctaatgcctggcatgtgcgtcaacgcatctctgaggatggaatttaaaggcaagagctggaggcccagggctgaggctgtggggtgagcacagcatttgcggggcgcgggaagggagtggctggtggggcgggggagggaaaccagcacgttagaaggtcagccaaggtcaggcggccagcagggcgggaggaggcgttggtgtgcacacgcggggagcctccgtgtcctcaggacaccatggaagacggcaggacacacgtgcgagccacagcaggtgggcgggagctcacaggctgcagaggaagcgcaggggaggcgcaggggaggccaggctctggcatttcccaggaatgtaaaccccggtttcagctttccccgtggctcccctccgccaaatcttaaatcctcttgttaagacgcgctccgcccctgtgtccttatttcccaccgtggtgggcagcttgtctgccatccccttccaggtgccccgcagaaccaccacccttgggaaggcggctcctcgtgccccccctcttgtgccttccctccccagtgccttttctgaccccctcctgagaccgcctccctgtgggccatttgagcacctgtagctttccatccggtgtcttcacccctttgctctttgtagctgtctcaccccgctgcagcttgtgaggccatgcaggccctgatgtttagtgttttttttgtttttttttttttttttaaagacagcatctccctttgtcacccagaccgttgtacagtggcaccatcctagctcactgcagcctcaaccttctgggcataagcaatcctcccacctcagactcctgagtatctaggactacaggctcttgcacccaccacaccgggctaatttttgtattttgttgttgttgttgttttgtggagacagtgtttcaccatgttgctcagtctggtttcgaactcctggcctcaagcaattcacccgccttggcctcttaagtaccgggattacaggcatgagacattccctaatgtttagttttaaagagggggtggtgctatttatctccaggctcaaagcagggcattctttccttaggatctgcgatactccagtcaaggctgtttcttttctgccttttgtaaaactcttgtctagaaattaatggatgagggaagctagggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttacctatttttaagcaagtaatataatctcttggttccaaaaacaaagcataaagaaaagtctcctatctgcctacctccccacccactgttgttgattttttggtgtgtatccttccagagtttcattatatacacagaaacaaataccagtgtcaccctcctttgtatgcacatagtctagcatgccatgcacactcttgtgcaagtggctttttattttttaaaattaacaggccaggtacagtggctcatgcctgtaaacccagcactttgggaggccaaggaaggcggatcacttgaggtcaggagtttgagatcagcctggccaacatggcaaaaccccgtctctactaaaaatacaaaaattagctgggcatggtggcgggcacgtgtaatcccagctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggacaggaccctcccctccccttggttattttactaacttggaataacgccacttccttgtaggaaacaggcagtgactgtcagtgagtgtgcctaggagaggggtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaataaagagaaaaaaaagacgcaccagcggcttacaagatctttttttgtttttttttttaagagacagagtttcactgtcgccgaggctgaagtgcagtggtatgatctcggctcactgcaacctccgcctcccaggctcacacaattctcctgcctgagcctcctgagtagctgggattacaggcgcgcaccaccatgccgggccaattttgtatttttagtagagatggggtttcgccatgttggccaggctggtctcaaactcctgacctcaggtgatcctcctgcctgggcctcccaaagtgctgggattacaggcatgagccactgcacccagtcacgagatcttaaagtagaagtaactatggtatttttttcgagaattctgttagggcgagaagcccattcgtactgtgctggaaccatcctgaccctgtctgttctttgcaggaactcaaaccaatatgcctaagtagctgaaactgttgcatttcaaagccttttcaagcatatcttgaggacactgttccctgcagctgaactgaagtcttgatctgagcccaggaggagtccctggggttgtcttgttgggggtggggaagtgggaatgcttgcattcagctttgggggaccttaaccctttgccccctcccctgtccccccttcacatagctttaacatgaaagtctttctgtctgtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttggctgtcccagttgcttccctgtggctgggagcccctctctgtggttgaggctggtcttaccattgctccagttgtcttcggccttctggggcttacttcccctgccctggaggcctgaggccagccagccagtgtggtgtgacccccctgacagtgggctctcccggctggcccagttgagggtggtcagttccttttgtggccttgccttcttgggagataaaagtggccccctgggtgccgtgcggcccgcccgcagggtccttggtggagctccagcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggttcacgtgatgaaacacaggccatgacccctttaggaattggatggaagccagccaggccaggccccccacccccaggtcctgggttggggctctgtgggcccaaggagtcctccagaaccaaattctccactaagagcaatttttaaaagagcagctgctcatcccatgtccaattagagtgagcagatgtgtaagaaacatgtctttgattgattttgggggagccccccgcagtttgatgttttgcttggaggtaggggaaacgggggctgagttacaagtattacctgtaggaataaacaattcttttgaaacatcagtagggaagaaagaaaaaaaaaggcagcttaagatttatctaaaaaggaagtggaaagttaaagttgctggagatctcattactgtctgtctcgctcaccgtaattaaaaaatgcctgaatgatcttaataacacatgattcagctgacaagcactaattgccctgtatcaggccaagagaagatgaatgttgtcaagaaaaccacaagtcagacaagctgattctctgtgagtctgacaccgtgttcccatgtacagaccagtttttactggagttcttccagcatcaaaagcagcttcttaccttcccattaattttcatcgctggcaggcccgagttgtttgcgatacactgactacctcccttgattcctcctcgctggctcaggagcttgggtctgcagacaaaatgtaaatatgtttcttgctcttatctttgtcctttttcagggaagaaatctgttcccgtccaatatgaatgccctggtgggcttgtcagtaaattacatggtatttgggaattgattttctgacgccaccgatttgtcaagaacttatcctgccttttcagcgatttgacagcacctgttaggctgtagggccatgtgattgggcagttctcctgccgagaaaaaggggactgatgactttctgtcacttgggcatccagaaacctccttgaaggtggaggttattgagggaggaggcaggagtggaaaaatgctattggtttattcctgtgcttttatagaacagccgaaccattctatggcaataaaacagaatcacagggcaaggtgcagtggctcacacctgtcatcccagtattttgggaggctgaggcaggaggatcgcttgagcccaggagtttgagaccaaccttggcaacatagtgagaccttgtctctacccaaaaataaaaaaaaaaaatcagctgggcttggtggtgcacgcctgtagtcccatctcctcgggaggctgaggtgggaggatcgcttgaggctgggaggtgggagcttgcagtgagccatgatcacaccactgcactccagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaattaaaaaagaaaaaaagaccactctaaaggcatttgtgcatgaagacacctacagaaataaagccggggtgctgttcttggtcttcattcaggctagcacctctcgtcaccttttcactttggagctcagggcctggttcactcagcaagtgagcggctcacacagtagatgctctgcacatagtagtaggtactcagaatatagcagctgttgatgtacatgtttccagaggggccaacacaggaatctgcacgtgggtccttgctttaagcccagcccctctctgtgggcgtgggatggagtcttcctttcttggtgaccggcgccctctggggtcactggaggcctggacttccccactggcccagtgaccttgtttccttgttccctgtctcgcccagccttggctgtcctgggatttgaaaatctgggataaagcctttttcgggcctctaaggccctgctggttctgcgtgttccagagagctgcacctctgggtggtgagctggcctttttggcatttgatttatgtatagccctgagtcactgggagcggatctagagtccaggccagtgactgatttcaaacgctaacactcttggctcgggctcaggtttcaagtcagcctccaaaggggatgtttgctcatttcgtcatcttcctatcacagcaattttcgtcatatggaggggtggcactcatgtaccttgatgattattattcttttaaaaaatgaagttatttatgttatggggtgagttcgtcacacagtccgaatgtggaatgttgccatccttttcatcccaatcctgccagtgatttctgtttacaatagaactattgacattgtatggggatgaaactagcatgagatagtaattgttggcttgcctgagattttcatcatatgtacacatagacaaaacctggctttagttcctaaagctattgctgtttattgtacttttattagccaatgttacagatccccgtagcatgccagaggctattaagaaatacaggggtcgggggcaggaacgaagtccctggccatggatcatgcaattgatctatagttatttttttttctttttctttaatttttttttgaaattttaaattattattattactgttttttgcgatggagtttcactcttgttgcccaggctggagtgcaatggcatgatctccccctcccaggttcaagcgattttcctgcctcagcttccggagtagctgggattataggcgcctgctaccatacctggctaatttttgtatttttagtagagatggggtttcaccatgttggccaggctggtcttgaactcttgacctcaagtgatccaccgacctcgacctcccaaagtgctgggattacaggtgtgagccaccatgcccggcccaaattattattattttttataagataggatcttatcacacaggctggactgcagtggtgcaatcatagctcactacaacttccaacttttgggctcaggtgatcctcccacctcagcctcctgagtagctgggacagcaggtacatgccaccatgccaggctaagttttaaaattttattttgctagggggtctcgctgacttgcccaggctggtcgtgaactcctggccacaagtgatcttcctgccttggcctcccaaagtgctgggattataggtgtgagccatgcttttggccaatttttagttattgtggatacataatagttgtacatattcatggagtacttgtgatgttttggtgtaagcatacaatgtgtaatgatcaagtcaaggtaattgggatatatacttatagttagcctacagtcttattgataatgttctcagaaatttctgattccagagctccttgctcctctcccataattagataacgtgtttttctgtccggtaattgctgtagtactcatttttagatggggtagggaaggccatgtgccatgttggggcctcatcccaaagaccttgtgctgtttgggacaggtaattatttaaagccccgtgtgaggtgggtgggtgttaaactcatgctctccacaccttcccagagtgcctgggaaagcaggcttctctaagaaagtggaatagcgaataggcagtgatccctgagagagatacataatgattgtcagtttcatggattacagataattccgtttaatgtcctctgtttttcctttttgcaaatttctatgcattatatagaacattgactttagcatagaaagtgctaattcttgatttggcactttaatggatatttacacagtgacaccataaacattggataaacagaggatttgttttaatgagatcttcagtgatttgaagccgtttcccccttgccttctggaatccccggctccagttctgcctggttttggtgatgctgtcacagtggagggctgactgcaggcctcgactgtgagccctcactcggccaccttttcatttcctcgctgggttccaggctctttgaagcactcgcctcctcccctccctgcatgtcctctgtagtgcctatttctgtgatttgcatatagcggaaatatttgttgaactgaattatttttacacacaagcctttcatgtggccaacattttgaggtctgtctcctttggcgggagtctgggaggaatcttccagttcactaagaagtgtttgatagcttcagggcaggcgtgccctgattggggctggatgccctgcctccatccagaggctctctggccaggaggggaatgaaccaagtgcccagattcccccctacaatgtttatgcagaggtgactgtcacctgccaatggtgacagtccaccagggaagtccagaaggcctttggattaaagctacaggagaggcaggtccccttgcagggtcagaaggggaagagagaagagagagagaaccaaaggtgggaggttcagctactcgggaggctgaggtgggaggatccctcaagcccaggaggtcaagtctgcagtgagctatgattgcaccactgctctccagcctgggcgacagagcgagaccctgtcccaaaaaataaaaaataaagatggaaagatgggaggattctccccaggaaggcccaggccgcagggtccccttgtccttaaaggccagctcagtgaggctacaggtccccttgccccagttccccgagcacagagcaggcatggcctcggacgacttcctctttgtgtctcgtggactactcaataaatattaatgttttccaaagatatcttgcccagctctccctgacgaggctgttggcttgaaggaataacaacactcgttgcactcacggaatattaagtctgtgccagggcctgttctgagctcatgacttgtgctactcggtctctccccacaagctcacagggcggatgctattttcaccgccgtttataggagaggaaactgaggcacagggtccttcagtgactggcccccatgagcaggcagcacatctggaattccagcctgtgcagcctggccccaggatccccatgcctctgtgggggacactctggaagtgacaggtgaggcacttctctggcctctctggatctcctgctggccctgaatgtgggtggttacccttttggggtgctgtcggtgcctcttagatgtctcagtgaccctacagggtctgccttccataggactgcctttttctttttttttgagacaggttctcactctcctgccaaggctggagtgcagtggcacaatctcacctcattgcaacctctgtctcctgggctcaagtgatcttcctaccccagcctcctgaatagctgggactataggtgtgcgccgccatgcccaactaatttttttttgtagtttttttggtagagatggggcttcactgtgttgcccaggctggtctcaatcttctgggttcaagtgatctgtccaccatggcttcccaaagtattgggattacaggtgtgagccactatgctcggccggcacccacctttttgtggacttttctttgttgacttggcattcggcaaggtgtaggcttttgccaccaacacgatacccgtggggagaagccccctggcccccgtgcctgccagaagaaaggcttagggtcccctgcgaggacccacacgtgcactgcatgcctggatagcccatgccagcctcactgaggctggatttagttcctgagtatgttatggagaagtgcccagagcagggaccgcaggcacaaggtgggcctggcctttggaggaggctgggcacggccacctgctcctcctctctcccatgggcaggttggccttgttgccattggaaactcttgagagcccacgggtgttttctggccatgtgacctaaatgggaggcttgctgaagggtagatgctgcttcaccagcaacaagaggagcccccagacctcagccacaggatggcccccaccctgctgagcccccactcttcgctccctgctcagcagagcaacacataccattgcccaaaggatggaccaggcacagcgtggggcccaatagcaaatgttctgacgaaggaggtcagtgccggacactgctgggcgttgttgagtcctgggctggcagggacagttttgcagggacggtttggaaggggctttgctggggagggggtctctaggaggggcagcccctgaatagggcagccgagttgctgtgactgcatcttcctttctttccgatgggggcaaaactcactcttctttttaaccattctctgttatctgtttttcttttcttttgaaactttttttttctttctttttttttagaaagaggatcttgctctgttgccaggctacagtgcagtggtgtgattatagttcactgaagtcttgatctcctgggctcaagcagtcctcctacctcagcctcctgagtagctgggactacaagtgtgagccaccatgcctggataatttttattttatttttttagagatagggtcttgctatgttgcccaggctggtcttgaactcctggcctcaggtgatcctcctgcctcggcctcccaaagtgctgggattacagacatgagccactgcacccggccatgtcctctttttctgattcgggaggataagggctccccatgacactggcatcagcattgggagcatttccgtgaccccagggctgctgatacaccctgtggacagggcaggacccacagctaagtcagtaaagcaccatcctctgggagtggctgtcatacgacatttcttgcttttaggaccattggactgaaaaaccaaatcctgccactggatctggtgatgacggtgacatttttttttttttttttttttgtttagaagcttatgattcatcggatctcttttggtttacggaaagcccagatgtcgtggtccctctgcgtgcccactccaggagaacgcattcaatgtcaaggaaccctgtagtgtgcaaagttggatttagggatttcccgaataaagctcactgagggtcaatgagttccataaacattattgaggccgggtgtggtggctcacgcctgtaatctcagcactttgtgaggctgaggtggggggatcacctgaggtcagaagttccagaccagccctgccaacatggcgaaaccccgtctctactaaaaatacaaaaatctgggtgtggtggcacattcctgtaattccagctactcgggaggctgaggcaggagaatctcttgaacccaggagacggaggttgtagtgagccgagatcgtgccactgcactccagcctgggtgacagagtgaggctccgtctccaaaaaaaaagaaaaaaaaattattgaatgtcttccttgtacctgacactgtgctttatcccatttaattccactggataatatgttaaattcagacttgttcgtagatttatatacatgtacatatccctcttaatacattggtttattctgtttctccatgttcataccgccagcctgatgcctcatttgcacaaatgaatggatgagtgaatccagcttattcttttatttctccctgggatctggtatacaagagatggttattttttaatttgagacagagtctcactctgtcacctaggctggagtgcggtggtgcaatctcagctcactgcagcccctgcctcctgggttcatgtgattctcatgccttagcctcctgagtagctgagattacaggtgcacaccactatacccagctaatttttgtatttttggtagagtcagcatttcaccatgatggccaggctggtcttgaactcttgacctcaagtgatccacctgcctcggcctcccaaagtgccggaattataggggtgagccaccacaccttgccaagagatggtcattaaagttgaattttggcactccttgcagaaaccctacaaagttggtatcacctctattttgcatatcagaaaactgatgctggccaggtgcagtgactcatgcctgtaatcttagcactttgggaagctgaggcaggaggattgcttgaggtcaagggttcaagaccagcctgggcaacataaccagaccccgtctctacaagaaaattaaaaaatgagttggatgtgtacctgtgatcccagatacttaggaggctgaggtgggaggattggttgagtcctggagtttaaggctgcagtgagctatgattgcaccactaaattccaacctgggcaatggagcaagaccctgtctcaaaaaaaaaaaaaaaaaaagtgctgagagagatcgtttcccgagggtctttggatagtttgtagaaaaacagtactgttccttctaaagccctgtggctttttccctattccaggtgcacattggcctttgaggctggaaaacacttttacttacttccagctttatgggattcataaaatggccttgagaaaagtaaaccgatttttctccttctaaaaacatccagtgggccgggtgcagtggttcacacctgtcatcccaacactttgggaggccgaggccggcggatcacttgaggtcaggggtttgagaccagcctggccagcatggtggaaccccatttctactaaaaatacaaaaaattagctgggcctggtggtgagcacctgtaatcccagctactcaggaggctgaggcaggagaattgcttgaacctgggaggtggaggttgcagtcaggcgagatcacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatggggttgacggggagccctgaagccggcagtgtttagagattcaaagaataggggggctgtggggagtcttttggttcacagcagtgtcccccaaaccggcacagtgggatgagagtgggctggccagggaaggggacagggtgttaggtccagaggtgctaaaatccccaaccatggtcaaaatggggacatgagagactcggggttcagagctcacatgaaggacagctgtccccccctccacccccgccttgggtcagagctggctaggagagcccaccctgcagcctgtccttcgtgggaatcagcatgaggggtgcaaagtgctcagcaaggcccggcaccaggtttgttcttgggatcagagtgatacacgcgccttacattttttttaagctgctggttttgcgggtcagtacggggaaaaacggtgagtcccttttataaaatatatagagaggttggtgcgaaaatagcagcttgtttctgcttgcgtatttctactcactgctgggacacaaatctacccttccattttctgaattgtattcattcaaactctgatttaacctctatttagttaatgaattgggcaagttaacctcgaactcttccaggctgtggctgttaccgtcaccatctcctgcttctcactttacacactcatatgagaccttttttatttctgaagtgtggcctgacattgtttaggctgttgtttggtgcttatttttaactcttcttttgtcacttaagtaggatgtcttaattcttgtttagtgttagatcacttagcaggattttttttttgagcgggggcggggggaatatgattttgtgtcacattttgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagacagggtcttgctcttctgcccaggctggagtgcagtggtttgatcacaagtcactgtggcctctaacttacatgcttaagcaatcctcacgcctcagactcccgagtagctgggaccacaggtgctcaccaccaggcccagctgacttttgtattttttctagagacaaggcctcataagtagttgtttcccaggctggtctcaaactcctgggctcaagtgatcctcctgcctcagcctccccaaagtgctaggattataggcataagccctcacacccagccaggactggatcccttgactcacttaatgatcggggtttacttctgacctgcatggggtgctgtggggaacccagagatcaataagacagcccgtaccttcttggagctgtatttagcagggtcatagaagacgcactcataatcagaaaccatccagaatgtgacttctggccagggagaatagggaagggttcatggagatggtggcatttgattgaattctgaatttggggttgtaggtttcaaatattagtttggggacagtcatccttttattttcttctctaaatttaaagaaattgttatttttaaaaaccaattggaatgggtattgaatttctgtgtggagaatgtctaccagtttttcatcattttctccactgtatagtgtcaataagtgttaaatgcaatggtctgtaagactttgttgataattttcttttctttgacatagacttgtaaactggaaaccctgtgtgggtaatgggcagtgcctatttcagcatcttgtccccagaaatccactccctaaaaggcttgttgaatgaatcagatctaggagcatctcttttgtgttggagcggagagtcagtccggactttgagcctctccttgcactgaccagcggcaggctgaagacagttggacttaagaaaacttaatctagaagcaatatgctggtcagattctttcaatgctaggtttagtatcgttcctttttctcccatttggtgaagtggtgtaatgctttagcacattttaaataagattacacaagcggctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaattgaaaaatgttgttaaaatgtgctttctgttcctatcagtatgttgttagtgcttatatagccatgctcgagtcagtgaaaattggtgccctttgccaaaatactttttttcatttttgtgtataattttgtgagctaggtctatttttgtttaattaggccctgcaagagaatgagggagagctgtatttaaatttttagaccattaaagggcctaaaactatcctagatgaaaggcccccaaaattagctttaatatttattatatgaataaaaccaatagggaaaacgtttccagaaaccctttctctttttccttcttcagacagctggctaagattaattgcaggcctgaacgtgggcatgtttgctagtttctcttgttctattactagaaaataactcttaagagaggagagaaataccgtcttcttgtatttggggggcaggctgtacattttataactcactaatataatgaaatgtttgttgataacatcatattttgctttctgatagaaaagtcctaatttctattttctttttactttttatttttattactttttttttttttttttttttttttttaaaatagagatgagggcttgctgtgttgcccaggctggtctcgaactcctgggcttaagcaaccctcctacctcagcctcccaaagtgctgggattacaggcatgagcaactgcgcctggcaagtttgttttactttttatttttattactttttgtttctaatttctactttcgacaggattccttttaaaattttaatctaggaaacaaaactgcacgtgaaagatttgccttgtagacggaaagttctggaaacatcagctccaggctgtggtgtgaagctgtcgggctgatttgcctggtaagaagcgcgtttggggcacggagggtcaccttgccccctgcgagcgttctttcatcatttgagcagccaagcatcccttttgggccaagtttgccaaagactctaacgtagagaagtggacagacccagttgcatgctgatgttaggggcagagagaaagaaggaaagatccttgcctagcttaagcccttgtgcttcttccccacatttatttgacttcccaaattggattggctgttgtgattgaaaagattgtcagcactatgtaaatgagaatgagaagtaaaagtgcatctcatgcagataatttctatgtagataatttgccataaaaatttatattgcagtccttaaaaccttcggagatttagtctgtctagggaaaggtgatttatacggcattaaaacactttttatgtcccagtcctttagatttaatgtttattgcctataaaaatgaaatcttcttgtggatatttaaaagttttggtactgtgtgaaatatatattcaagttagaaatgctttggagatgttgtaaataagtggcaaatctcttgctccaaagtccactgtgttgtctgggcccgcatcttggctttgcacgcctgaaaagctgcctcgggtaccggtgtctgatcatcaccatagtgggtcgccaagtaggagaatgtcttatgtagggatttggtggtttttcaaaaaacttaaattagctaacaaggatgggactattataattcctcagaaagttatgcaaggtctgaccagaatttcattccaatctgcagaaagactgaattatggtgcagtttttttggttttttgtttgtttgttttttgagacggagtctcgctctgtcgcccaggctggagtgcagcggcacgatctcggctcactgcaagctccgcctcctgggttcacgctattctgcctcagcctcccaagacgctgggattacaggcgcccaccaccacacttggataattttttgtatttttagtagagatgggatttcgccgtgttggccaggctggtctcaaactcctgacctcaggtgatccacccgcctcggcctcccaaagtgctgggattacaggcgtgagcccctgcgcccggcctatggcgcaggttttaaagagtggaagtgctttgacaatggaatgcccagtacaaagcagtttttaggcttttgcagccactcagattcataacagcacgcttcaattctggtcttaaataaaactctcatggagtaaataaatcatatggtggggacagcactgctgtggaggagggtactgtttaagcattttgggggttcctgaaagatgtttctcaaagtgagcgctggagaggagtacctggtttgattgttgaactaaagtgtggtttctgtaaccctagggagttcttccctaggtatgattgagctccctgagtgctgggatggtgacctccccagcctgtctccaagtctgagtactggtcggcttcctagactccttaaaacgctgggtattttatttaattaatttatttatttttgagatggagtcttgctgtgtcgcccaggctggagtgcagtggtgcgatcttggctcactgcaacctctgcctcctgggttcaagcagttctcccgtctcagcctcctgagtagctgggattacaggcatgcaccaccacgcctggctaatttttgtatttttagtagagacggggtttcgccattttggccaggctggtcttgaactcctgacctcaaacactgggtattttggaaatcatgtgggaagtgcttttcctagagttttgtagctcctcaaaaaggcagaactaatcaaccaggcttccccattgtagccacagttggatcccaatggtaagggccattgggaaaccaatggtctgggtgagtctggcctgggaccctggcatggggaagagactggacttgaaggctttggatgggcagcttggtctggacagtattggaaataaaggaacttgagactttgaaattgctgtgatgggggtgttctcacctgtccataggggtgggatgtcagtaagctttgccggtgtctgtcccatagatagactcagctctgcattgcagccccaaaaggagcctgcattcttaaaagaattttaggggaagaaagatttaagagagcacctgaagtcctgaatcccttcagaaggaattcatggctgcctgtagtcagctgccagtccaaccttgccctccaaaagaagtcacagagattgagttttcagcgaggcagggagaagttgtcacatttgcctaattcttgtagaggtgagagtgggagtaaactggaagggggcggattattggtgatttgggggccacgtttccttgtatcacctgtaaagttttttttttgtttttgttttttttttttttttttggagacagggtcttactctgtcatgcaggctggagtgcagcggcacaatcacggctaattgcggcctcaacctccccagactcccaagtagctgggactataggcatgcaccactgcacttggcgtatttatttatttatttattattttttcgaagagacagggtctccttatgttgcccaggctgttctcaaactcctgaagcaatccgcccacctcagcctcccaaagtgctgggattacaggtgtgagccaccatgcctggctcacccataaaattaaaatgaaaagagcagaccacagccagcagtcttccgacctccagctcttgcaggtcgtgggcagccttgccccaggtgcagcaggtaggccaggaagcaggtgtgggaacagagcaacagcaggcaccgtggggacatgcacagtaagcgtcgaatcggtgtgcgtttgcagaaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacagaaatttttaaaaagtagctgggcatggtggcatgcacctgtcgtgtcagctacttgaaaggctgaggtggaaggattgcttgagcccaggagttcaagcccgcagtgagctatgatcgtgccactgtactccagcctgagtgaagggcgagatgttgtctcttaaaaaaaaaaaataataataataaaataaagaaaagaaaaaagtagaggttctgtgcttagttagaagatatctaacaacacaattggttagactttcataattatttctgctgatgtaagtatcacagcgcaggtcatgggcaacagtttactgttttcacacccagcttcaatgttaaatgaaccccagactatagcgtgaccagtctgatattatcatccccaaatctttatagtttcagctcttgggatggatgactgaataaccattttttttccagtgtggtagtcttagggttttgcttattggtgtgtgtgtttcaagaggaacctctgttccttggacttgatgtgagtggcaagtcatgtaaaaagctggattttatcaatagtttttgtctaaaaaccaaaaccaaaaaattcttcccctgcagtaccagtgcttgaaataaaccaccctcctacccccacccagcttgcctgcgtggatccagtagcacccccggtaccccggtgggcctttttggcagccccgaggggtcagggatctagggggaagagtcaccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatcaccaaggctgcctggtccaagttgcttcctgttgctgcatgggcagtgttctggggtccagaccctgggtggtagtgataagatggtgatggggtggagtgggtccttatagatcccacattactgagcggccttttgcccttcaaaccagatcacaatcccctccctgccagttggtcctcaagaaatcacaggaggctgggcgcagtggctcacgcctgtaatcccagcactttgggaggccaaagcaggtggatcacttgaggtcaggagttcgagaccagcctggtcaacatggcaaaacccggtctctactaaaaatacaaaaaaaattagccaggtgtggtggtgcactcttgtgatcccagctactcgggaggctgagacaggagaatctcttgaacccaggaggcagaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgtgaacttggagagtgtggggagctgccccagccgagggcactggatgggaattcatgccagaaccccatcacatagcggcaggagctgtaattgtgcttcttaattgtgtatcttcatttagtgcgagtttaggtggttagcaatagctctttagctagctttacagagtctaagttaaagagcccctcagctatcttgtagaaagcgccctggacaggatggggtgatgctgacagctggagtcactgttccagcgcccagaatggggagactagcagcacttctgggcagcccatgaagcagcctcttccctctgccggtgtccctcatgtccagcagagctagaagtgaaactcactgaggattgacgcggcccctttaaaatcgcatctccgctcttggcaccaggagctgtcatgtagtgtaacctgttggtgcccagaacccaggtttcctggtggcagccagcggtaccggtgccaggaggcagcgaaggaatcacttgcgacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaaaagccaaacctgacagtttcaaaatgaagttattagcacttcacctataactgtgatagcttttaacttgcaggatccttctcttaggcaccacctcccatccgaaccccagagcatatgggaaaaggagctaatgtgtgtaagttgcaggatacttaatcactgaagaatctaacaatgataactactatctctctggaacttttttttaacttagaagagtatgtcttgttctgtttatatatcacatagttttccaacgaccctgggaggtgaggtaggtggtatattttaccaatgggaaaatcgatgctcaggaagtcttggtgacttgctcaagttcccataacaagaagctgctgaatccaggatggaacctggtctaccccaaatgcccctactgcttcctagggcccagtaatgcccctgggtagggcgggcccagctctggaagaaacagggctatacaaaaaatcacccaatattgggtcaccagccttcttctacttgcaaaataattaagcaaaatctgtttttatttgtttttgagacggagtcttgctttgtcgcccaggttagagtgcagtggtgtgaacttggttcactgcaacctccgcccctagggttctagcgattctcctgcctcagcctcccgagtaactgggattacagacttgcaccaccacgcccggctatttttttgtatttttaatagagacagggttttgccatgttggccaggctggtctcgaactcctgacctcaggtgatccacctgcctcggcctcccaaagtgcgggggttacaggtgtgagccactgtgcctggccacaaaatctattttaattctgcaagttataagcagccagtggcccaccaggcccagctgtacgttcccagggaccccccaaagcgtatatgtcccgggcacacacacactaggtggtttgttttgttccccagcagcccgtgtctgcccgggcagatgttagtggctgagaaaccccaacagggagtgagccacaggcccgcgggtggcttccctgccagtgttctcctcgcgaaggggaagggagcccttgccagaatggctggtgccctaacaaattgattcctgccaaacaatagaaataaatattttcagcagacagaaatgttggctctgaaagcattcaaattaaaggcttatttctgaaacaaatactttaggaggaaaacatttttaccagcgcagatgagatcagagctattccttttggcagtggcaggactattttgagactcagccacaacggtttccctgccccgtctcgtttttcactgatgacctcgccccctgtttcatggagacagggaattgcattcagctagaggcatggggaagagatggtggcatggtgttctgcagagagcctcagttggacagtcggccgaatctggattcaaatccaggccctacctctcctgctatgatttcgacaaagccggtcagtcatctgatcatcagcttcctcagtctgtgaaatggggcggtacctcccttgcaatggttaatagcgttatcctcaggacctgggggtcattggaggccagcactgtccctagaactctctgtgttgattaaatggtctctacccgccccagcaaatataattgccactagctacatgtaactgttgggcccttgaagtatggcagctggaatggagggaacaaattttaaatttaacttagatgaaatgtaatccacatgtggccactggctaccattttggatagtgcagttcccattcatccctctcatttcattagttggtccctggagccaattaattggttggagggtcaacccactacaaatctcccaagtctttctctgtgccggatgcagctgtgcggagttgggacctgtctgttgtctttgacatccgtcttctgtcctgcagacggagcagtggggcagtgccatcgagctgggcagaggaattaatatcttagccatcaactgcccaaatcaaccttcatgggcatcttttaattttctaagagatggggtcttgctgtgttgtccaggcaggactcgtgggctctttccgcctcagcctcccgagtagctgggactacagttgtgcaccaccacacccctctgatatttcttaattttaatggctgatgtttcttaattttaacaagttcccatatgtctcatgatgtatgctaagtataaaaagaataatagaaggcatgaagtcaaggggcctgtttcccgggcatttgtttcagtggtgagtcacattcatgcgaagcctcggtttccttatctgtaagaccagatcagcaaaccacctgtggctgcctctctccctggttgaccccgaggccaagaggaggggcagggtcagcagccggccagacctcagtagcccctccccatcctggtatgggggaacacaggaggtagaaaacaagtgacctacacaaggcgggtggtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaacacagtgagaccctgtctccaaaaaaataaaatttgtatgtttatatactgagaaattttgtctccgcctctgtccctttttacccctactgtctaccctaagtcagtactgtacttctgttcattttctgggggtgtgctgaacagattcaagagaatagcatttccatggaaaggccgcagcttgtaagtttcacttgaatttccgtgattgggagttaatatcaaatgatctctcagaatcaagaaatactgatacatatcaaatgtataataacattttgagaattttttttttttttttttcagacagagtctcactctgttgcccaggctggagtgtagtggtgtgatcttggctcactgcaacctctgcctcccgggttcaagcgattctcctgcctcagcctcccaagtagctgagattgcaggcgcccaccaccacacccagctaatttttgtatttttagtagagatggggtttcaccatgttggccaggctggtctcaaagtcctgacctcaggtgatccccctgccttgccctcccaaagtgctgggattacaggcgtgagccactgcgcctggccccattttgagaattaaaggaacatgggcacgtaatctttatacgaggtggagtcagattgaatagcaagaggaagagaaactgacatccacgctcattgcactgggcgttttatgtgacttaatcctcatagcagctctatgaagtatgtatcagagggtgtccccattttacattaaatcacttgcctggatcactcagctggggagggtgagagccaggtgacctacccaaggctgtgtctctgggtggggggctcagaacctctctccctcgttttgtagtagccagacattgtctcgtataaactatggcaactggaagtgaaccaggtcttttcctgccctctgattttggtggaaaatgtgacctacccaggaaaagcactatgattttaggagtttaggtgcacaaagctgttttccaagcatgctcattcttctcccaatttgggactcattgctgcctctctgccctcatctgtggggccaagggagctggagcgacagccacagcagaccgctctgcatccctgtatgcgttgtgggaaacagcagaggaggtggcgttgcgcccatcttacagactccagattctgttcacccgacaggcagtgggaatccgtgttcacgctggtcccttggatcagaaattcagtacccttccctccacaccatgctgtagacacctctttcctctcctagacccggaacatcctctcttcttcagggtactggggaccaagatccaccctcgtggtgagaaaaccacaccataaataaacacagccaccatacgccgtgagatctggccaagaggtttccttctgttcattcggccctaatctccaagatgggaaggcattgccagctgccctgtgtagagattcctgaacacgcagtgtttcttattaacccgccagataaccagaaaatcagtctttgggcaagcgcttgcttctccacgtgcccagtattttctttctttctttttatttttttaatgagacagggtcttgctctgtcgcccaggctgggctcgaacttctggcctgaagtgatcctcccacctcagcctcccaaatagctgggactacaggtgtgcgccaccatgcccagctaacttttttttttttttctggagagacagggtgttactatgtggcccaagctggtctcaaagtactgggctcaagtgatccccccacctcggccttccaaagtgttgggattacaggtgtgagccactgtggccagctattctttaatttactagcgctgactacatgcctgtgatgtccccaggaccctgcaaagttctgggaaattcatagtgagcaaaacacagtccttgctggagttcacagcccatggggagacggcaccaaccctgtgcccagactaggggagctgccacgcagccactcactgagctgggcacacaggttcccatctcttatgaggtgaggcaggaggagcagggagggagctggggaagtggcatcagaacattttttggaagagagaaaggaaaggtttccaagcagaaggaacagcctgtggcgaggtccgaggggaaaggaggggaccctgttctctggggacactaggggaacgtcagcatgccaggtcagggttctggggagccctgggtggtcttatcgatggcccccaggaagccacagaaggcatttgagcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgtatctccagctttcctgctttcaactatgctttttgtctccttttcctcattgcgagcctaggcctgtatggggtggtggagtgggtgggagctcactgcttaggtgggtgggcagtgtgggtggtggtggttccatgggtctctccctcccactgtcccatctttgccactcatctgctgccccccactcccggaccccttttggaggtcagtctcactctgtggaaaccctggcttcctggttcgagatgccccctctggcccacgtgtctgacatcacgtaccagaacactgtggccatcattcaggattttttatgacacagtagtgaatcaaagcctgtcagtgggaaagtgatggggaaggattaagtgtctgagaacatttgggaaatatgaggttagacctggttctcaaacttatgaaataagtgaaaacatgaacgttcactttgggaattctgcaagattctcctttaaatggagtccatgaagagaacaaaatgaattttctgcagcgttacgcaggagcacttttctggaaatgaggtttcctaggactttgtcagcccttcaaagcctaggtctccttactagaggggaagaaatgagattttatttatttttatttttattttttattttttgagaccagagtctcactctgtttcccaggctggagtgcaatggcacaatctcggctcattgcaacctccgcccccagggttcaagcgattctcatgtctcagcctcccgaatagctgggattacaggtgtacgtcaccacacccggctaatttttgtatttttagtagagacagggtttcaccatgttggcctggctggtttcgaacttctgacctcaggtgatccacctgctccagcctcccaaagttctgggattacaggtgtgagtcacccactggccacaaacttatgaaataagcaaaaacatgaactttaactttaggaatctacaaggttctcctttaaatggagcccacgaagagaacaaatgaactttctgcaaatgagatgtcctaagaccttgtcagcccttcaaagcctaggtctcattactggaggggaaaaaataagattttaaaatatcaatgtttagccagactcagtggcttacccctgtaaccccagcactttgaggaggctgaggtgggaggatcgcctgagcccaggaattcgagaccagccaggacaacatagcaagacttccatctattaaagaaaaaaaaaaccatcgtttacttttaggagtaggcattacatttacgtgcttaaaataccaaaggtacccaagtgtagatatgaaagactttcccacccccaagtgagtgcccagccccttaatttccctccctggtatggatactaccagtatcttatgtttgtagaaccttctacagaaccttgtgtaggtagaagcagattctatgcatctatgtgtatctgtgtatttgcagtgactagattgattgctgttgatggacatattctggggaggtgtttttacacttccattactgagcacaggctcacaggatggcactttcccgcatgcaccaccatgcctggctgatttttgtatttttagtagagacagggtttcgccatattggccaggctggtctggaactcctgacctcaggtgatttgctcgcctcggcctcccaaagtgctgggattacgggcgtgaaccactgcgcccagcctgttttttgtttgtttgtttgtttgtttgtttgtttgtttttgaatagagacagagtttcactgtgttggccaggctggttttgaactcctgacctcaggtgatccacccacctcagccttccaaagtgctgggattacaggtgtgagccaccatgcctggcctcaatttctcccttttctaagccccccacctctgtttttgtcccatggtctggtcctgtcggccttgttgcacctggcagtcagggttgacttatgatttacttgaaccatccctggagcccctggcctggtgggggatgctggtggcagaatgaattcgggtctgaggtcaagcatgtgtctgtgagagtacacaaaatgaactgtgatgtagcgtttactgtgccacaaacttgaaatgcatcatcttgattatgtccagagaaaggaagtcatttgaccacagccacacaggttacaatggggatgcggcctggagtccaggtgtgagctaccacacccagcccacatacactttaaagatgagcaaatccaggctgtaatcccagcacttagggaggctgaggtgggaggatcacttgaggccaggagtccagtcaggtttgggaggccgagacaagaggatcgcttgagcccaggagtccagtttaggtttggtaggctgaggcgggaggatcgcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggtgggaaaattgcttgaggccaggactccagtttagacaccactgtttgaagcgtcttgggatgttttcagtaggggacttggagaagtgatggaaagaggctggtgggtggggcttaggcccaccacccctttctagccagagaaccctccattcatcgaaatgattctgttgttggaaatgaaacaaaaaataaaatggtcttaggaccttcctgtgcaggaaccatggccgacctttccctttttgtacaagtgatctatttttttcactagcaaaaccatttaagatttctatataggatgtgctgtttgattagtttgacagataatcccccaagaaacatcagatgaactcactctttggattaaagtttgagataataaaacaagaatacttgtgttgctgatgtggccagcccaagtatgtttttcccaccagcccagaggttctgggggcaggaggcatcctttgcaggcctagaaggacccaccctgtgggagcctggccctgtgcatctgcagagagcacttgctggaaatctcagtgggaaatggtggggatgcctcccatacccccactttaaaacaaacaactgacaattacacttttttttttgagacagagtctcgctctgctgcccaggctgaagtgcggtggcaccatctcagctcactgcaacctccgcctcccgagttcaagcgattctcctgcctcagcctctcaagtagctgggattacagatgcacaccaccatgcccagctaattttttgtatttttagtagagatggggtttcaccatgatggccaagctggtttcgaactcctgacaattatactttttgagacagggtctccctctgtcacccaggctggagcacagtggcttgattatgactcactgcagccttgacctcctgggctcaaacgatcctcccgccttagccccccaagtagctggaaccacaggcacccaccaccgtgtccagctaatttttgtattttttgtagagatggggttttgccatgttggcaggctggtctcaaactcctgggctcaagcgatctgcctgcctagacctcccaaagtgctagaattacaggcatcatccactgttcccggcccacatacactttaaaggtgaacaaatccaagccaggcatggtggcttatgcctgtaattccgcactttggcaggccaaggcgggcagatcgcttgaggccaggagttcaagactagtctggccaacaaggcgaaaccccctctctactaaaaacataaaaattagctgggcatagtggctcatgcctgtaatcccagcttctcaggaggctgggtcttgaaccctggaggtgaaggttaaccagtgagccgagatcacaccagcgcaccccagcctgggcgaccgagcaagactgtctcaaaaaaaaaaaaaaaagatgggcaaatccaaatggatctctggtgttatttaaatacttatttgggaaaaaaattttcccactatttctgttaagcagacagctggttacatggtagttttttaattttgtttttaataacatctgaaatgcctggcagaaagtctggagttgggggcagagagaaacttaaaatgttaggagctttgccctttgaggagctgtcagaattggagaaaaaacatcccagaaattgtaatcagtgaggaaaacaggattccagctatccacagcaccccagctgtacaccagcgtcacgggatgagggatgcctgtgtgcacgtaggccttggtttctgagctgagacagcagcagccaggccgacttggtgataggcttggcctgcccctgcagtggactgcctgggcctgggcctgggccttggccttggtctcagccctgtggtggatgatctgagccttggctttggccctccagtggatggcctgagccttggccttggccttggtcctgccgtggatgacctgagccttggtcttggccttggtcctgcggtggacgacctgagccctggccttggccttggccctccagtggatgacctgaaccttggccttggccttggccttggccctgccgtggatgacctgagccttggtcttggccttggtcctgcagtagacaacctgagccttggcaattggccttggccctccagtggatgacctgagccgtggccttggccttggttctgctgtggacgacctgagccttggccttgaccttggccctccagtggatgacctgagccttggcgttgaccttggcccgccagtggatgacctgagccttggcgttgaccttggcccgccagtggatgacctgagccttggccttgacctctgaagctcttctgtgcaagggtggggctcctgttggtgacacccacttgctgagtctacacctgggaagctcttggtcagctcggcccattgacttgagagaggaatagttgccgtccagcgagtgctgggggtgtaaggtggaccgggccacacggctgccaaggggccggctgggtgggactgaaacctgacccatgtgggtcctcattgcctcctgacatcagtcatcctgtgatctcttagaaagataaaaacacattttctgcgttctggtgcctctccttgccagacattttctcagtaaagtttctgtctcagcctcgttggaagtgccaggttctgagcccatcagtttgctgctagcctgccagcttcccatgacctgggacctgggaccaggggcccgcaggtgtttctagctggagaggagttctagatagttctgagcggataccctcctctgtcttcctcgggagagttctggcttggtttggtggtgttttctgtgaccagcagtggccaccgccaccaccaacccctcttccccctcccctcttcctccccctcccccctccctcctcctcctctatctccatacgccctgagactggccagtgggcagcatattgtgcaagaaacagctgttgttttgacaaaggacataactcgcctcacttcttgcatcaccagacccacgaggctctggattccaggcctctgcccctgcaggtggacacacagaccgtaacgcagaggctcacgtgtcccacactatgcattaccatttgtgtacgcactcgttcacatttagcaggattgtaaaaattaatagttagtgcagttcttccagctagataatgcatccaaatggcaagacagtccaaagatacacactatggagtaagtccctctccccaccggcccctctggagagagccaggcacggtcacaagtttcttctgtatccctctggagataatcacagcctatgcgagcatatggatggatattcttttaaacattgtgttgcggtttgctttttggcttggatgtatctgatgattatcatatcccttacaatacaccgtgtttttttacattacaggaaaatctgtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaaggtgggttcaccttgcaccgggccacctgtttcagtttcctcctccaccaggcaggctctctgacagatcagcccagggaggggcaggtggggaccgagggggacggagggggcccacagacccccggctcatctggcatcttccccagcgtttcccacacttgacccactagatgagaagttgggggtcggggctgggaccccaccttcatacctccagcgcctgccaactcaaagacatcggtagatgcccaccgattgggtaaccgcccccagcacccccaccctgctaggcttccatgcagtgggggaagtagggacccccggccaaaagcagtcatgttctttttgtttttctcctaagttttctgcgtctgtgtgcgattggaacgaaacatcaactctttttttttcttttttgtcatatttcaatattggctttcttccccgccttctttcgaaggctccttttataacttcggctgctgctgcttaaatatagatgtcaaagccctcctccctccagattgtttatatttttgaagagccttctgcttcgctgtgactgctcctctcttatctgtatcccccgttccaccacattggtttcggttgctcttttttttttttccctgccttcccttaactgggatgtgtttcaaatgtggtctatcaaaatgttcagtgtttcccttttttctgcaatagctttgacatctgttcttgaattctagcccacgttattccttaggacttgtttgcccaagatgtgcctgaatgccagaaatactaaggggagaagagtgtggtgtggtggtatcttcccctcattgcctggtttgttgttttattgtcgttgttgtttttttttctttcctcccctgctttttaaagtgtctacgattccttccttcttccttccttccttccttccctccctccctccctccctccctctttccctccctccctccctctttccctccctccctccgtccttccctccctccgtccttccctccttccttccttccttcccttcttccttccttccttcctttcttctttctttcttttttcccttgggacacctcactcatgcccaggctggagtgcagtggcgtgatctcggctcactgcaacctctgcctccccggttcaagcgattctcttgcctcagcctcctgagtagctgggattacaggagcccaccaccatgcctggctaatttttgtatttttagtacagacagggtttctccatgttggccaggctggtctcaaactcctgacctcgggtgatccacccacctcggcctcccaaagtgctgggattacaggcgtgagccacctcgcccggcctgtccatgatttgtaagttgacagcatgatttcatcccatccggcatggcccaccccgtagtagtaccaaggaagcatttcccagcaagaacttgtaacgtgtaggtttgctggttaacttccgccaaggaggaaagcctgtgggacttggtgagctgggtggtggggggtggagaaggagaggctctagtgtgcttcttggaggcgtggggataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagctcttcccagaatttctgaggccagggcacaggttctctggcgcgttgattatcggtttgttgcggggagcagagcccagagtcctcagccccctagcgggtccctcatggggaacccactcctggtggtcctcagcgttcccgcgcaagtaatgtgatttgagaataactgccaatggtgcctcatttctgaaaagtggttggaaataattattcttggaatttaccttttaaaggtccctcttgaaaactaatcataggttaatggtctcgaacatgatgcttggcctagagtgagctcaccataaacatttgttgaatgaatacaaaccaagtattactctcagagatcccaggcccacagcattgaaggacggccacacggaatgccccgaggaggggatagatcagcagaaggactagagctcaggagagtggctggctggaaggaacccttgggaagaagaggcgtggagcaacttggggaggcgggtgctttgggcattagcctgatagttgtggctggagcaagaaagatgtttctgtgtattctgttatgggaacagagtcatttatggcgtgcacattgaggcacgacccatgatgttgaacgagcttggttttctcaaccacttcacatgggacggacgtgggatggggggataatgttcatttctctgccttcccgccaccctccagcccctcctctgccaatgagttgatgttccttagagccactggggtctctcccccagtgttctggtcaaatgcaaataggaccctcctctagtacacagtgcaattacaatctcacttttcctttcctgtttccccaacagagagaactcgatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccatataagacataggaacatgcctggaggcaaagctcctttctaggagagatgcccctctcttacttacataatattgctgggaaattatatgtgaattgcatttttaaaagcggactcatttaaaatgtttcaaaagaggcttgctagtcaagggactgctggcatgaatcattatggaaaacaaattaataaccttctgtcttcagaataaatattttaggagaaagcttggtagcagagtagaaagaaggcagcctttggccacagagccagctaagggttcaaatctcacacccgctgcttgcctcggctgcccctaaatgtgggtactccatgtttcacgagaccaaaaatgcaggtgggagtcactggtgcttgggggtttctgccttctctgccagtgttggggagtggggggccctattctccatgtcagccttgccatgagtaaaaacaggaggaaaaaaagagctggggacagaacgtccttcttctgttgcctccagcggcttcagagcagactttcctggaactccggtttcctgagcgcttgtccttgactcagtttccccagcccaagccccgccacatccatcgtgctagctcctcttagtgccgttcctgtagctagtggtcacccaccgttctgtattgtcactgccctttcctcggtgaccatatgtctgagggtttccatagaaaatcttagaggtttggctgggcgcagtggctcacgcctataatttcaacactttggaaggctgaggcaagcaatcacttgaggtcaggagttcaagaccagcctgggcaacataacaagactcatctctgttataaaaggtaaaaagaaaaaagaaaacgttttgtggttaaaaacaaacaaagaaacaaaaaaacccagaaaatcttagaggggcaaggccatccttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagaggggagctggctgcaggctcctgccccgccagccctatgcactttctcatccaaggaccaacctggaaatctgtggggcgcccacgcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatatagtggcacaatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggctgcgcacaggcctgtccctagagtttagcttatgttcgttattagcattaacctgggaatactcaccgtgtaactcatgagatacagtggatttctgttcctcagagctagcttggggaatttctatgttttattttattttatttatttatttatttatttatttacttatttatgaggcggagtttcactcttgatacccaggctggactgcagtggcgccatctctgctcactgcaacctccacctcccaggttcaagtgattgtcttgccttagccttctgagtagctggaattacacgtacccgtcaccatgcccggctaattttttgtatttttagtagagacggagttccaccatgttggccaggctggtcttgaactcctgacttcaggtgatccacccgcctcggcctcccgaagtgccaagtggcatgagtcaccacacccggccttagctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtacagtggctcgatctcggctcactgaaacctctgcctcccaggctccagcaattctcctgcctcagcctcccaaatagctgggactacaggcatgtgccactgtgcccagataatttttttgtatttttcatagagatggggtttcaccatgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttataatcccagcactttgggaggctgaggcagatggattgcttttgctcaggagttggagaccagcctgggcaatatagtgagacctcacccctacagaaaaatagaaatattagctgggagtggtggtgcgtacctatggtcccagctactcagaaggctgaggtaggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagcctttaactagaaaaagtttaaaaattaaaagtgaacttttaactgttaccaattaaaccctttaagccagtttatcaacccaagacattattttctttcttttgggtctctaggggagaagaggtgccttgagtgggaccagtaatgaaggcaatttgaacctaattcgggccccagtcagggaaggtggctgcattatccccctacatcccagcaagactttgccgcatggtctggagggcaccagcaggggcctgtagggaagaggaggttgcctgggcccagggacattgaatgctagtcaagccctggtttcatttgctccaacagcattaatagtattgtgacctccatggcactgtgacagaaacttaaccccagtttcttcgtctgcaaaaaacataccctgcctacttcaaggggtcctggaggctgaatgtccagtctcaggccaggagtagaacgcataactagtaagtggtgacgtgcagtgaccttgagcaaggtcaaaaactgttctaagacttggtccccttatgtataagcaggaagaattggtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctctgttccttgtcactggaagtggtcagagctgttgcggggcttggcccaggggcggcgggtggcatctgaagaccccgcaggccctgctttccttccgggagcatctcaggacggccgctttgtctgtctgcccccgccccttgctgaaacgtcaacaaggccggcatcccctttccttcctgagagccatgtgtcgcttccttcatgtgtccagccgtttttacagggctattttaagtataaaagacgcattatctgagagtttaataactgtcaaaagggaagcactgtcattagattcatgtgccctggaattttagtcaaaaacatgctgcgttctatcacgtctaagcctctattttcttatctcaaaaaataggaatgataacgacctcggagtcattatgggctggatgaactcttatagggattcagaacaacccaggcaccaagtagaaggtcaataaatggcttattgtgttcatgttaccaaaatctactcttttgagaaattgtgttcacaaatggccttttttttttcttttttctttttttttttttgagatggagtctccctctgtcacccaggctggagtgcagtggcgcgatcttggctcactgcaacctctgcctcccaggttcaagtgattctcctgcctcaacctcccaagtagctgggactacaggcacctgccaccacgcctggctaatttttgtatttttagatggggtttcactatgttggccaggttggtctcaaattcctgaccttgtgatctgcccgcctcggcctcccaaagtgctgggattctaggtgtgagccaccacacccggcctcacaaatggactttttttttttttgagacggagtctcgctctgtcacccaggctggagtgcaggggcgcgatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgagattacaggcgtgagccactgcacccggccacaaatggactttaaagttataaatgtgacggagggcagtggctcacacctagaatcccagcactttgggaggctgaggctggcggatcacttgagctcaggagtttgaggcaggagaatcgcttgaacccaggagatgggggttgcagtaagccaagatcgtgccactgcactccagcctaggctacagagtgagactccgtctcaaaataaataaaaataaaataaagctataaacgaacacttaaaaaaattattaaagcctagggtagaccctagtttctactgcggacttgaacagatacagtaaaattaaaacttgccttcttccatatgtgtctagagagtaattttctctccttttgcattagtttcactgttcatagagtggaaatgtttgctgctggactttcttttttgaagctattctttgagagtagcccataacttgtctttctggtcaataacctcaactgaaatgcattctgaatggagaacgtcattctgtgtaggatttaataataacttcagcacagaaaagcactctctgcctcttctcagcaaacaactttgttgagcatgattttaaaggtgtaacggctaaatgtgaaagccatatgatttggttgaaatcgtggtgagctgttattaatatttattgagtacttgctaggagtcaggcattatgctaagtgcatgaccatcatttctctgcccctggaagtcaccctgggagctaagtatcatcggtgccacttaatgaagcgtaagccacccacccacctaccaggattttcccgggcagacagactcctgggaatgaggccatataatcccctgaacaccctgcctccttagggttccagaagccaattttttttctttttttgagacagatttttgttcttgtcacccaggctggagtacagtggcctgatctcggctcactgcaacttctacctcccgggttcaagcgattctcctacctcagcctcccaagtagctgggattacaggcaccaaccaccatgcccggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttgccattggcctgtgaaagccttcttaacttacggaattgattataagccaaagcgtgggaaaatctccccttccactttgagattatgtcagtcaagaaaatgacaattggataccaagccatgctaactctgatacttgctgtcttcgttttcttctttctttggctagggggatggagcgcgtgtggtgtgggtgggactagtcactgagcatgttattgactaacattggcttttcattttaacttgcaaatgtgagtggcataaaagtgagtttacgaggagcatgactggcctgttatgcagagtcttgtaattttgtttgtggccctttattttaagaagatgttgtgttatatagttggtgtccttaaaggagtatataattggatctggaagcttagattgtgattctgacttggccacttaatgaatgcaagatctgagcaagccatgacctctctgttgttcagtctaagaaaggaggtgttggtgctgagcatggtggctcatgcctgtaatcccagcactttgggaggctgaggcggacgggtcacttgaggctgggagttcgagaccagcctggccaacatggcgaaaccccgtctctactaaaaatacaaaaattagccgggtgtggtggagtgcacctgtaatctcagctattcaggaggctgagacggagaatcacttgaacctgggaggcggagattgcagtgagccgagatcacgccactgcactccagcctggatttcagagcgagactccgaggttctgtgtggctgagagccacacattttgcaacaagagactcgtcccttttccataggtgtccttattcctattgatcttacctgtgggcccaagacttaggcacatccctttcttcttaaaaggcatcacctcctctgcctcttggagttttcctacccagaattcattcatgtgtgcagcaaatattcctggcagtcccattgtgtgtggaatggggtaaaccaggaagactgttgtgagggctcagtaacttcagggacacagccgtcgtagcttataatggcagctgatatttagtgagcacttactgcatatccagtactattctaaacactggaaaggcatttaactaacttaacactcacaggatccctacgaaacaggtacagtgtttatttctgtttcaaagagagggaaactgaggcccagagaggaggagtaacttgcctaggcccacaggtggcaaagctgcctgaaggttttttttgagacagagtctcactctgtcgcccaggctggagtgcaatggcacaatctcagctcactgcaacctctgccttccgggctcaagcgatcctcacttcagcctcccaagtagctggggctacaggcatgcaccatggtgtctgactgatttttgtatttgttgtagggaggggttctcactatgttacgcacgctggtctcaaactcctgggctcagtccctcccaaagtgctgggattataggtgtgagctaccgtacccctcaggaattcttattttttagatggaaattttaaattggcttttattggaatctcattaaatttgtagatttggagaggctttagaaggcattttcaagttttgattgattgttttagatttcattcataggtgaatttcattctctatattttacttgagggatccacggaaactacctacatggacttcacttactctggttcattgtgtgggatacaaaatcgtcaaaattgaaggattgatcattgtgtctggagccaggcataaaaataaacctcactctgttatcataggtggctgtgattaagatcgagggaaatgtcggccctgggcctcctaacattgacagtttccttcagaagattaagtgcggcttcatttttggcccgggccatcagtagcttaaagccattactgtctattggctgtttggtttgtctgaaatatggggccggcgtcagcctatttccctggggtcaggtgtgttcacataatcaaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggtgatagcttctgtttccttgaattaaaagctgcagacaagtatattttcatttattttgtttataaatcaacaacccacgaaaggtatttcatacgtatttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctgtcttttagccctaatttagaaaaacttgtagcgctttcctttgaaatgatgaaaaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagaggtgaaaacagcattgcccggggtgaggagcaggaggaggaagggtccacgtataggagtggatggaggggatctgtgagacagctgctgggacagatccgacttggagactgtcaggcctctgagcccaagctaagccatcatatcccctgtgacctgcacgtacacatccagatggccggttcctgcctttactgatgacattccaccacaaaagaagtgaaaatggcctgttcctgccttaactgatgacattatcttgtgaaattccttctcctggctcatcctggctcaaaagctcccctactgagcaccttgtgacccccactctgcccgccagagaacaaaccccttttgactgtaattttcctttacctacccaaatcctataaaacggccccacccctttctcccttcgctgactctcttttcagactcagcccacctgcacccaggtgaaataaacagctttattgctcacacaaagcctgtttggtggtcttttcacacggacgtgagtgaaagagactgccattcatgaatggacaaggcctggctccgtccacgctttcccagctctgtgtcctgccatcggacatgctggcacatctgctgtgggtgccctgcacttctccgggcactcctggcccagctggggaggttggcatggtatccaccattttgttctaaagtagtaaatgaaactcttgggagggcagcacccagcagatgtttggagctagagacagggctctggggatgtgtaggaacccggacctggtgtggcaatggtgtggggctgtcacgaggcgtgaggaggctggggtggtgttggggacagcacacgatgctggggctcaggccaagtgaagcttggacttcactctgtctgaggctttgccaagtgtcagagggtgcacacttgggagtcacatggccaggctcacatttccagccgaagttacactctacagcctggcagcagatggacgtttggggacagaggtggagccggaacagctgagacactgttttagaggactctgcgagaaacacgctcttaaaacaaggaagcggtggttatgtcttattcaacaacgatctgttgtggaccagctgtgtgccaggcagttgcaggccctgaggctgcagcagtgagcagaaggccaaggtccctgccctcgcggtgcttacattctagtggagacagatgttaaactacagggcaggaaaacactgtcaaggagatgcaggtggaggattctgactgtggaactggggcatagagacagtgggttttgaaagcacttggctgagaaggatgggaggagggaggagggaggagggcgggtacatctgtagatggaccaggttaaggtatggacttccccatcctgacaagggggagccccaagcttgttttcaggtgtgacgggggtggggagaaagagagcattccaagagaggcacgaacgtcatttccagagcgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggctaatcataaaaacctcctgggtgtgtgtgtatgcttgttaaaaatactgtccctgggccccaccctagacttagtgagacacagtcaccggggaagggcctggggacttgcatttagaaccagctcctggaatgcttactctgaggccagtttgggccccctcccatggcctccctctgtgtcccttcctccagatgctgattgaggatgtgtcccctgccgggactgtgtttgcatgtctctgtctctgtcacaaagtagatgcctggggagtgtgtgctgcgtggccccctgaagaccctgtaccgggatgtcagcaccccagcccccagctcctccccctgtgaaagacattagctcctggaggggctcaggtggtggaaatgaatcttagcatcaatgtttagacctaaaagccatctccaggtcatcatagcacatgacagagatagaggcagaacctggtggccataggattatttctgagcaaagatcgcccaagctttggcataggccagggttattcacatgtccgagtccctggaagtggggtgtgaggaggttgtggggggccttcagaatgagggaaaagggataaatcaaaatcaagtctttttttttttttttaattgagacagagtctcgctctgtctcccaggctgcagtgcagtagcacgatcttggcccattgcaacccctgcctcccaggttcaagcaattctcctgccttagcctcccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaagccaggagaagggtgaataattgaattacagatgacagtaaatatttggatctagctgcttatgaggccttaatgatatcagtcagtacaaaaggttgatatccatgttttttggtgtgtgtatttttttttttttttgagacagtctcactctgtcactcaggctggaatgcagtgacgtgatcacagctcactgcagcctcaacctcccaggttcaagcgatccttccatctcagtctgctgggtagctgggaccacaggcgtgtgccaccacacccagctaattttttgcagagacagggtctcgctatgttgcccaggttggtctctcaaactctggggctcaaatgatcttcctgtgtcagcctcccaaagtgctgtagttacaggcatgagccactgtgcctggccgatatccaccatgtttggagcctgtttttggttacatttcatcctcatctactggcctggagatattggtgtcaatcagttcttcactgggggaagagatttttttaaaaagtcagatttacactcagtaagattcacccttttcaggtgtccactttgatgaattttgacaaccacatatagtcatgtgccaccaccactattaagatagaggacaggctgggtgcagtggctcacacctgtaatcccagcactttgggaggccgaggttggcagatcacccgaggtcaggaattcgagaccagcctggccaacatggcaaaaccctgtctctactcaaaacacaaaaattagccgagcgtgatggctcatgccggtaatcccagcactttgggaggctgaggcgggcagatcacttgaggtcaggagtttgagaccaacctggccaacatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagtctggcttctttcacttagcgcagtggatttgcagttcaacagtgtggccgctgtcagtgccaagtagtattccattgtatggatgtaccacagcatggagggatttttaaggctggtcaggcagtgcttatgtcacaggtccaacatccagtcccctgggccatttaaagccaagcacagccccacacctaaccctcgtctgaacgatcttgtacagccactctgcagtttcacatcctgaatgtgagcagtctttttttaaagaaggaggttttgggccaggtgcagtggttcatgcctgtaatcccagtactttgggaggctgaggcgggtggatcgcttgagcccaggagtttgagactggcctgggcaacatagtgaaaccccacctctataaaaaaaatacgaaaattattggtggtggttgcctgtggtcccagctgcttgggaggctgaggcaggaggatcacttgagcctgggagtttgagaccagctggggcaacatagtgagacccctgtctataaaaaatacaaaaattggggctgagcgcggtagctcacactttgggaggccaaggtgggtggatcaggaggtcaggagttcaagaccagcctgaccgacatggtgaaaccccatctctactaaaaagacaaaaattagccaggcatggtagcgggaacctgtaatcccagctacttgagagcctgaggcagagaattgcttgaacccgggaggtggaggttgcagtgagccgagattgcaccgctgcactccagcctgggcaatagagcgagactccatctaaaaaaaaaaaaaaagccgggcatggtggtgtaagcctgtggtcccagctacttaggaggctgaggcaggaggattgcttgagcccgggaggttgagaatgaagtgagctctgattgcaccactgcactccagcctgggtgacggagggagaccctgtctcaggaaaaaaaaaaaaaagaggaggttttaatgttcgcaaagctggtcagtttccaatctggtgtcaccagtggaaaaaagatgtaagtgttgttggcaagagaagctcacccagagacacgctccatgaagtccctgacccccgctgggggtgcctgtgatggagggtaggctgtggtgcctgcgggcgcgcacaggtgagatggaaggaataaggggttattccttctgggtgcagctctgcctggaggccagagctgtcctcctcccttcgatctctgaattaaagacgctcttctagtattttcttatgttgatatatatgtgtatatatatatatgtgtgtgtgtgttttcttattgttctagttcttatattgtcatttaattcctttgtcctttagcttgcaagggaatgtgttttcttattagattgtaagctctggggaggtaagaccagcacttccaccctcccagatccttggttgggcacgttattgatcagtccacatctgttgcttggctgattgattaaatgctgtggtgcccgtgttcactgagggattccagacccctgtctagcccaaggatgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaaagtcagaaggaaaagggcagggagccgggcttccttgaggcaggtggctcttttaaagctggggcatgttgtcgccaatctgagcttgtttccatggacgcagccagccgggcagcctgttcccgtcaacctgagccctgatggagcctcggacctgacaggctgcctggggaactcactgggaggagggcgggttgggggagacccagaagccatgctggagtctctctctggcctactttttgccatagtttgaagggaaagttagtgaattgccaggatcaacctgcagtttccccaaaacttgcacaggagtggctttcatcgctgcatggggagacctcctttgcgggtctgcttagcggtagctggattgtctctgagggatacctggctttcctaactgttcctggagaatcttaaagacgaaaatggaagaaagggctcacatctttgttttgtgctgcaagcaaagtcttggaaaaatgaatgatgccaatggaatctatttcttgtaattaatttcctcaagctactggatctccttttcttgctgagattgtggtttggcagctgcagtttgatagccccattctgagactggatccctctcttccctcatctggtagttttcacgtcggggcattcctgaactccgtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctatttaaaaattaaaaaaaaaaaaaaaaaaagacaacttgagccgcacacaggttcttgccaaagcctctattagtgctgtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggctcacgcgggagacgcatgctcctccgtgactgtttgtggccagtgagccaccagttgacaccagcaatccagccttctgcccctctcacttcacagatgagggaagtggggatctgcctaaggtcacactttggtgcatttctcaaatcaaacccaggagccggaatttttctactgagctcctgctaagacaccctgggtcgtttcctccgggcagtccatgtcatctgctgtggcgtgtatgttcatgggtgattctgtttctgtttttaaaccctgtgcctcttggttggtgcttttcctcctggaggatgctgcagacctgcagcggtcacctcgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgctaagcctttcagatgagttccccgtggtcatcagaggtaggccttgctgtcttaattttacaaaagatgaaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttgtccattatttgggctccgtaaacttggcattatcacgacaattagttgttgagggttttctaaaatgatttgcaattacatctcttaagcggaaaactgtctgctctgatggagtgagaatccattccctctgtgccctagatccactttaggaattggcttttcataggggaacgtggtgcctcgggattttataataaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggcagagtgcttgctttttttttttttctttttcttcctttttttttctttgagacagagtctcactctgtcgcccaggctggaatgtagtggcacgatattggctcactgcaacctccacctcccgggttcaagtgattctcgtgcctcagcctctcaagtagctgggattataggtacacatcaccatgcccagctaatttttgtatttttagtagagatggagttttgccatgttgcccaggccagtctttgaactcctgacctcaggtaatccacccacctcagcctcccaaagtgctgggattacaggcatgagccaccacgcctagcgagtgcttgctttttctgctagacagtggtcctcaggcccaatccctgagagaggggcttctgagaggtgaaggaggcaggagttcttgcccctgactctcaggagctggtgtctcctgggcatcactcacggatgggctgattattgctcattaccccacaggatccgacagttccagtacaagctgcttctttgagacagagtctcaccctgtcgatcaggctggagtgcaatgctggcgcgatctcagctcactgtaacctccgcctcctgggtttaagcgttctcgtgcctcagcctcccgagtagctgggattacaggcacccgccaccacacccggctaatttttgtatttttagtagagacgaggtttcaccttgttggtcaggctggtcctgaactcctgatctcaggtgatccgcctgcctcagcctcccaaagtgttgggattacaggcgtgagccactgcgctcggcccagaagacttatattttatgatataagaaaattatatgaaattcccaaaaaaacccagaaaattatatgaaattcaaatttcattgcccatagtttgttgtttttttaaaaaaaaaattgtagtaaaatacacataacataaaatttaccattttagttattttgaaatctacagtttagtggaattaggtacattcagtgttgtgcaagccatcactgccatccatctccagaactttttcatcattccataactcacctccataaataaagttttattggcactcagccatactcatttgtttatctattgtctgtggctgcttttctgggctacagcagcagagttgagtagttgcaacagagaccatatggcctgcaaaacttaaaatatatttttttcttctttcttttctttttttatagagatgaggtctcactacgttggccaggctggtctcaaaaatcccagacctaagcagtcttcctgccttgcctcccaaagtgctgggattacaggcgtgagccatgtagaatatttactatctgaccctttccagtaaaacttggccaacccctgtcctggtgcacactctccttacttcttagttaccatagcaactgcctaactggtctcacttcctttggtttcattccctttctgtatatctgccccctggaggagtttttccaagatacaattctgattgattaacttcgctggttaaaatcttttagcaggctggtgcggtggctcaacttgtgatctcagaactttgggaggccaatgtgggcagatcacttgaggcctgaagttctagaccagcctgggcaacatagcaaaacaccatctctactaaaaatacaaaaaataagccgggtgtggtggcgcacgcctgtggtcccaaccacttgggaggctgaggtgggaggatttcttgagcctgggtggcagaggttgcagtgagccaagatcatgccaccgcactccagcctgggtgatagggtgagacactgtctcaaaaaaaaaaaaaattcctttagcagcatcctgtagactaatgccatgtctgggaacaccagtcccaggataactgcactagttattaaaggctctataaactcttgcagaaaagaaacctgctgaacatcgatcaacccagtacccttcaaaactcattgactgggcaagtctttttccttttttttttttctggagacagtctcgctctgttgcccaggctggagcgcagtggcatgatctcggctcactgcaagctccgcctccagggttcatgccattctcctgcctcagcctcctgagtagctgggactacaggcgtccgccaccacaccctggctaatttttttttatttttagtagagacagggtttcaccgtgttagccaggatggtctcaatctcctgaccttgtgatccgcccgcatcggcctcccgaagtgctgggattacaggtatgggccactgcatttttcttatcacccattctcattagcctacagcagggattggcaaactgtttactgtaaagaaccagatggtaaaatactgtaggtttcggcagggccatatggtctgttacaaagactcaactctgctgtaaagtagccatagataatacaaaaatggtgggcgtggctgtatgccgataaaactttatctaaaaagacaatcaggcccatttgaactcctgtcctgtagagcagtggctgtcaaggtgtggcccaggccagcagcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaaaaaaaatttttttaagtcagccaggcatggtggtgcacacctgtagtcccagctactcaggaggctgagacgggaggatcacctgagacacgagtttatgtgtctgagacgcctgagacaggagtttatgaccatcctgggcaacataacaagagcccatctctatgacaaaatgtgaaaattagccaggtacagtggtgcacacgtgtagccccagctacttgggaggctgaggttgggggatagcccaggagttcaaggctgcagtgagctatgatggtgccactgcactccagcctgggtgacagagtgagaccctgtctcaacaaaataaaattgtaacccaaagtaagggctcaataaatgttagccactgtgattattctattattcccgtcctcgttgtaaatatttgtgtggcttggtgcctagcgtcttttgtagctgtatgtattgccaaggagaatcccaaggaaaaaaagtagaaatatggttaaagctggctgggcacagtggctcatgcctataatcccagcactttgggaggccgaggcaggcagatcacttgagtgcaggagtttgagaccagccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatggtgagaccctgtctctactaaaaatgcaaaaatcaactgggcctggtggtgcacacctgtaatcccagctactcgagaggcaggagaattgcttgaaccctggtggcggaggttgcagtgagctgagatcatgccactgcactccagcgtgggtgacagagacagattcagtctcaaaaaaaaaaaaaatgcaggttcaaggaagggagaggatgatttgtgttccgctctgcgcctcctccctggtccattcccttctccctgttggaccattgctgtgacacaggtgatctgagcatcaagaaaaaggcatttcttgcttctcagtgatattagcaagcacctgctgcttgtattcactgtgctgagttctacccatttattctctcattcagtctttacatctccctgatgaggaggcataataatatcatgcccattttatagacttgagggaactgagcccaagccattcagccagagagtaaccgagctggagttccaccaggtctgtctgctctgatagcaggcatgcctgacctccgcacctacccacttccccacttctgcagtctcatgtgtcccagggaacgcacagctggggcccctctcctaatttgcacccttcctgagccagttcagaagtcccagactgtgtctttctggctggctgtgtcactgggcccaaggatggtgctacggggctaaagatcttctacactgaccctctccactaacgggaaatcagaaaagggaacttgaagagaacattggcaccaatggttggacctagggatttgtagccacctttctaagggagatagaggacagggctaagagtcacaacttttgttctctacccttgagcaatcgaatacttgcaaagccctgtttctaaggttaaaaaaaaaaggctgggccctgtggctcacgcctgtaatcctagcactttgggaggccaaggtgggcggatcacgaggtcaggggatgagaccatcctggctaacacggtgaaaccccgtctctactaaaaatacaaaaaattagccgggtgaggtggcacatgcctgtagtcccagctactcgggaggctgaggcaggagaatggcgtgaacccgggaggtggagcttgcagtgagcccacgtctcaaaaaaaaaaaaaaaaaaaaaaaaaggaggcagctttgggggacaaaacattcagcgtggccggctctccgcatcttacagtggtagggatgaaatgcacgcgccctcatttgaaatgagaatcgcagtgcctcagttaaacagcggcctctccggatgccaagctgagatcatttccatttctgtgccgagatcggccttttgcagagatagatgggttatatttatcaccagctaacttattagcatgtgacaccagatacaccaaattgtaatctgactcataaaaggatatgtagttcatgacttgatggtgaagcaggtcagtttaaaaaaaaaaatcagatggattatggagtcaacgtttccttcagaaaacttcttcaggggtaaactggtataataggaatgtctgttcagactgttttgaaaacagttaccttgagaattttgtattcctttgacccagcaatcccacttttgaaaatctatcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagtatgcgagccctttgctggaacatgtttctggaatacttgctgttattagtggaaatattgccaccgtgccatgtgccagactccgtgtgaagtgtgcagagtgctaggtgggtaaaaatagcccccctccttctagaacctccaacccaaaggtgggaaggggcacacaggtaacagaaatgacagcgttgacatctggtgtgtgctgtgtaagtcatgtcatctgtgctgaaccctggggctcaggagagacgtagtggggctgtcgtgggaactgggccctacttgggagccaggatgtgggcccggcctgaagctgcagcagcagcagcagcagcaagatgtgagaatatttaggagatggaacttggttcagtgggaggagtaacccaaaaggactctagggtggtcctgagattttcttttctttttttttttttttttttgaggcggagtctcactctgttgctcagacttgagtgcagtgacacagtctcagctcactgcaccctccacctcccaggttcaagtgattcttcttcctcggcccctcaagtagctgagattacaggtgcgcaccaccatgcctggctaattttgtattttcagtagagacggggtttcaccatgttggccaggctggtctcaaactcctgggcttaagcagtctgcccacttcagcctcccaaagtgctgggattacaggcatgagccactggccagtcctgaagttttcacagaagcatgaaaacacagagagaattccttttctgtcataaggagatgatgcccttttttttttttttttttttttttttttaagagacagtattgccctgtcgcccaagctggactccagtggtacagtcgtggctcactgcagcctcgacctccctggcttaagcaatcctcccacctcagccctcctaagtagctaggactacaggctcatgccagccaccatgtctggctaatttttaaattttttatagagacacggtctggcagtgttgcctaagctggtctcaaattcctgggcttaagtgatccgcccacttcggcctcccaaaggattacaggtgtgagcaaccacgcccagcctggatgattggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgagcaggcagatcacctgaggtcaggagttcgggactagcctggccaacatagtgaagccttgtctttactaaaaatataaaaatcaggcgtggtggcaggtgcctgtagtcccagctattccagaggctgaggcaggaagatggcttgaacccaggaggcggaggttgcatcgagccaagattgtgccactgcactccagtctgggcaacagagagagactccatctcaaaaaaaaaaaaaaaaaaattgcagagagtttgtagtacatgggtcaggcttaagcaaaaagaaagcaacttaggaagtatatatacagtattattacaactacaaaaggaacaggcagaaaaaaccctggaaggaaccatgccaaaatattaagtctcctttagggagcaggacttggagtcgtatttctttatgtttttctgtgctttaaacatactctgccatgacatattccttctgtgatcagaaaaatataaactaacagtaacagcagaacatcccttccccccaaatacaggtgggaattagatgtctgaagagctgaaaacacaaatgtatcgatttcatctttttaatatttccctgcaattcatcttgccttaatcaccgttttctctctgtccgtggaatcacagagctaactgcacagaaacggtgtgaatgaaaccaagttggccctacgtggaatctcaaatcgctctaccctttcgggatcttccgtttaagtttttggataatgaaaatttgatcttgatttcaactaaagctgttgtgtataaatctaacctttctatttagcgaaggtttttagcggtccatagaggccggagataacgaactgttacttgtcttctgtctttcccgtgtctgccatgggttctggtttgtaggcagatataaatgcagatacgtgtgcccctgtcgtgtctgaaaggatgatagaagcgagctgaagactccttcctgggagaaatggatttctcccttgcttttagaatcctcaactcctcccattcattctgagcaatagccatcataccatatttcatcaatctcagatttcttttttcttcctttttttgaaacagggtcttgctctgtcacccaggctggagttcagtggtgcaatcatagctcactgcagcctcaaactcctgggctcaagcaatcctcccacctcagcctcctgagtagctgggactgcaggtgtgcaccactgcaccaggccaatttttgtattttttgtagagacagggtcttgccatgttgcccaggctggactcaaactcctggcctcaagtgatcctcctcccaaagtgctgggattccaggcatgagccactgtgcccagcccaatctcagctttctggtttggccaagggatttactttcaagttgtaaagtaaacaacttgtgcttttctgcttttgccatctcctggttccccctgctgatgccacctctgatgccacttgtcacctttctctaaaccacccccttctctcacctggcaggaaaattccctgcctatccttcagtgaccccagcaccggtttcagtgccagaaaatgtgctgtcctccctgtatttggctcgcctgtcctccccctcactgatgttttctgctcattgggtgggggaggaatcacatgggttaggtgcccatccgtccactcctgtattccatgcgcgaccacggtggcccaaagttggattccagcatgtgatgttgaatgaggcaggcgtggctcccgtccccgggctgcacccagcagttcatcccggatccaggcctctgccttcctctactctcacctcttctcctctgcagagaagtgactgctgctggttagtagggtgggaagtggaggctggagggcatttgagagggcagagctgagttctggcctgatccagtcactcaacagcccatttcctcatctaaaaatagaataataatcaattacttagtacctgtcaacacaagcctatgtatatatatatatattttaagagaccaggtcttgctctgttgtccaggttggagtgcagtggcgtaatcatggctcactgcagcctcagctcttgggctcaagtgatcctcccacctcagcctcccgattatctgggactacaggtgtgtaccacgacatctggctaactttttaattttttatagagatgggatctcactatgttgcccaggctggttgcgaactccttacctcaagtgatcctcccacctcaccttcccaaagtgttgggattacaggcatgagccactgtgcctgggcaagccaatattttaacaggccctttacctatgtaatttcacttcaacttctcggcaaccctgtgaggtcgggagatcgggtgttcttgtcaaaggcacatcaagaaatgacaaggcggtaccgggcacagtggcttatgcctgtaatcccagtgctttgggaggccgaggcaggtggatcacctgaggttaggagttcgagaccagccttgccaacatggtgaaaccacgtctctactaaaaaatacaaaaattagcctggcgcagtggtgagcacctgtagtcccagcttctcaggaggctgaggcaggagaattgcttgaacctggggggcggaggttgcagtgagctgagatcatgacagtgcactccagcctgggcaacagagcgagactccatctcaaaaaaaaggtgaaagaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaaaaaattagcggggcgtggtggcaggcgcctgtagtcccagctactcgggaggctgaggcaggagaatggcgtgaacccgggaggcagagcttgcagtgagccgagatcgcaccactgcagtccagcctgggcaacagtgtgtgactccatctcaaaaaaaaaaaaaaaaaaaaaaaaaagatgacttggagattgaaagaggttgaagagatagctaaaggcaatgtgtggacctcatttagattacagttggaaacaagccagcagaaaacgtgtttctgaaacaactggagaaattagaacagtgggtttctggatattttatgatattgaggcgttattgctattatttgtgaagtgataatagtgtttgttttgttttgttttgggacagggtctcactctgttgcccaggctggagtgcagtggcaccatcagggctcactgcagcctcaacctccccgggctcagctgatcctcttgccccaacctcccaagtagctgggactacaggtgcgcgtcaccatgcctggctaatttttgtattttttgtagaggtggtgtttcagcatgtcacccaggccccggattatagtgttttgactgtcttttttttttttttttaaaggatccttatcttttagagaattcacactgagatatttctggatcaaatgacttgatatctgagatttgcaacaattaatacagtaaatgaaacaagcctggccgagagttgatactcattgaaagcgcatgatgggcacatggggactggtgttactgtttgcttgatgtgggcttgtctttgagattttcgtagtaaggtggtattttgcacaaaaccccagctctgatttttctgggaaagtgggaaggcctggtgattgcaggctgctggagctttagatgggtgggaatgtcctaggtggcggatgtcccatggtcatgtggagggaaggatagaaagagcatggcagggggccaggtgccccgacaggtgagggccacctgcagggaacatcagaggtgtgtgcttcttgagggtcgttacccacggtctgtatctccctatattcaccaaaatacacgtgggacttcccttctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgctgttcacaggtgctgttacttgggggaatcataatgctctagggtttttggtttggggatttttctttgtttttttgagacagggtctccctgtgttgcccgggctggaatgcagtagtgtgatcgtagctgcctgcagcctcaacctcctgggttcaagcagctccccctgcctcagcctcccaagtagctgggactataggtacacaccaccacaactggatatttgttaaaatttttgtacagaggaggtctccctgcattgcccaggctggtctccaattccgaggctcaagtgatattcccaccttggcctcccaaaatgccaggattacaggcatgaaccactgcacctggtactagggttgtatcgtttgtcttttaaaaaatcttcacataaaagttaattgtggggtgggagggagttcctatatcaaaagtatgttgaaatacaagagtcaagaggttgagtctggggtccaggtgggtcccctggacaaccctctgcagacttgctgctgcttttgttaaagtgtctgggagtcccaagccacatggggtaggggcatcagaagagtctagaattattatttttgagacgtggtctcgccctgttgcccaggctggagtgcagtggcgcgatcttggctcaccgcagcctccgtctcccaggttcaagtgattctcctgccttagcctcctgagtagctggggttacaggcgcgtaccaccgtgcctggctaatttttgtatttttagtagagacagaattttcccacgttggccaggctggtctcaaactcctggcctcaagtgatccacctattttggcctcccaaagtgctgggattataggcatgagccaccatgcccggcctgaagagcctagaattcttcagccttctccaggatatccctgctgcctgggtgggagacaggggagagttggtagggagaggactgtgctgtggaggtatgactctgcaaggtgaccccggctcagcagctgatcagctctgtggccttgggcaggacacggggctccctgaactcctctctccacattggtaaagggtctggtcaggccagctgtgggctagtggtgagagtaacagagatactgatctgttactggaaacgccatgagctgattgctgtcattaacctccctgtactgagagttaaacaaacaggcacctaggatgggtgcagtggctcacacttgtaaccccagcactttgggaggccaaagcaggaggatcacttgaggccaggagtttgagaccagcctgggcaacatggtgaaacctcatctctacaaaaaaaaaaaatgcaaaaaattagctgagcgtggtggcgcacacctgtactttcagctacccaggaggctgaggtgggaggattgcttgagcctgggagttccaggatgcattgagccaagatcgtgccactgcactccatcctgggtgacagagcaagaccctgtctcaaaaaacaaacaaacaaaaaacagcaaaaaaaaaaaaaaaaaaaaaaaagcaggcacccagattttcctgtactgtaaagagaaaaaccttgaatttggattaggaaggtctgaccctgtcacaaacaaaagtgaccaaatcatacattttgaaattcacctcctttgacaaagccaggatcctcatgaaagagaagattctgatgtgaagtcagccctgcactttcagcctttccagcgtgcaggttgatagaatcccacactttttagcggtcgaagggaacttaagatgtagcagttatttcagagttgtgaagcagagaccaaaatagtttgaagctgaattttaagcctcttttggccagatcaaagaaacccaaactcctaaaaataccaaattagctttttaagcatagtttctatctttagttgaaaatgtgtgcagtgtatacttctggaacctgcttaaatgtatccattgaaatgaagatgtaccttgaaaaaagaggcgcctgatctgcagtaataattaagtaactttctctgcccttgactcttgccccaacgcgtatcaggattccacggtcccctttctccttcctttttcaattctgaaaccatccttgtcttcttgccggagttagcaccaaaaaaaaaaaaaaaaaaaaaaaaaagttactcttgtagtttacatgtcataaatgaaaatggatattccctcccagggcataatctgaaatatttgtatttgggtttcaaatgtgtgataagatgctctctgtggcagatcggcctttctaattgctgtgcttgttaaaattcaaattaggctttattctcttagcaaacgttgactgacagttgcagagagtggcccagaatggcactgagtgatgggtggccaggaagcctgcggtaggaaattcacaacagacctttcatagagaaacggctggccttgactttgagtccttccatcccaggtgctttagagacagagccgcctgacccttccttagcttggcccgggggtgcgttggagggggctgttcccacctgcagttcctaaaggacaaactgtctgatacaggcttcatgtggggctggccaaaccccaccgaggtttgcacacaccccaggattgcagaacctgagctcgaggagtgggacatgacctccccacgcctctgctgagtatcccagaccttcccatgtctttcttttctttctttcttttttgaaaaggagtcccattcagtcgcccaggctggagtgcagtggtacgatcttggctcactgcaaccttggcctcccaggttcaggcattgctcctgcctcagcccctcgagtagctgggattacaggcgcgtacgaccatacccggctgatttttgtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgtctggatttgtgagttgggtgatttcagatactgatttatttttatttatttatttattttgagacagagtctcgctctttcgcccaggtgggactgcagtggcgctatcttggctcactgcaagctccgcctcccgggttcacgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaagagatcgatcagaattttcttgcctcctcggacggcatctgacctggctaggttgcggggatctgttggagagagaagcgtgtcatggatcccgcatcgaaaacagccttgaagagggccaggagcacggaggacctggggagggccctgaccactggacacatctgccctttgctcctcctttttgtctctgctggtggccctttctgctgtattcacgcgccctcaccacctcctgtgtattcgtgtgctggagttcagccgccaaggtggagagagactccctgtcggggaaggactccggccccaatgcctcctcctccaggccaggccgccatggtgggtgggaagagaggccactcctagagaaagagacactgtcagtaggtgtcaggaggtgtcccgggagctcgccgcgtggtaaccaacagacacagcccttcttggcattcaaagttgcaccctgatgcctgtgagggagtcgtgactttctgttaccactgacccagggcagagttttaaacagtgaccttaaggcgaaaagctccagatctcgttactgaccagtgcagccagccactgccttccttcctttttgattctaaaaatgacactcgggttttagagggttgcttttcaggcagccgaaatccccgcatgcaccttctcgtacatttcaggagagaagaatcaagtccatccacggtatccttgcccaggtaccggtatccatcagagcgtgattggggtttcagcagagccaggcctgcttttcctggcagaggctgggcccctttagatttttcttgtagattttgcttgagcctcccagcccttccttgctcagcacctgtgacccactgggtcacagtgacccacatcccatggctctgaccgcagctggactcatctcacactcacgttcatcacggctcccagaaggcacgtgtttttaatgagaggctcatttccaccactgccccccagccctccgcagcaagccagtgcaacgccaggacagtctgctgacaggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctatactgtccaccttgccccagattctttttctttttctttttcttttttttttttttttgagacggagtctcacactgtcgcctgggctggagtgcagtgtcatgatctcagctcacggcaacctccacctcccaggttcaagagattctcctacctcagcctcccgagtagctgggattacaggtgtccgccaccatgcctggctaattttttgtatttttagtagagacggggtttcactatgttggccaggctggtctggaactcctgacctcgtgatccactcgcctcagcctcccaaagtgttaggattacaggcgtgaaccactgcgcccggcccagattcttttttttttttttgagatagaatctggctctgtcacccaggctggagtgcggtggcacaatctcactgcaacgtccacctccctgggctcaagtaatgctctcacctcagcctcccaagtatcaaattctcattttaaaaattaagaatcagacccaaaaagaacaaatgacttgaccatgactgaggccacagagccgaaaatgtccccatcctggagtcttactgtggcacactctcatcttaaccacacactctagttttatcctctctgtgtctttcatagattatcaggaagcgaaataacctgttaatattttcaaaagttcttatgaaatgtgaagtgctgtataatgattaagatagaaaggagaaactaggaaacgagagcttttaatcctagcttacaggaaattctaactagtaggaaatctaattcaggcagcgctgggaaacatcacaggctatgagatgaaagtcagctaaattgggatctaattctataatctaaatatagatgtagatatattacaggttggccttttcagctggagagagtatcattcactccaaaagtgccttttgtatcacagagaagagcgcagccaggggtgatatcagctgaggaagggggcgggcagcttggcgtgaggggctttcattcattccttagtcatctctattttcttaaattttatagtaggaattatttgtgcgttgtatgtataataaacacatggaaaagacaagagcgaggaaggcatctcaggagtgtttttgggaaggaggctgtcatggcatgtgggcagagggaggtctgggaatgggatttgctgggtcagaaagatgtccatgttctttgccaatttggcatcagaaatggcccacaccagccaggtgtggtggctcatacctctaatcccagcactttgggaggccgaggtgggtggatcaactgaggtcaggggttcgagaccagcctggccaacatggcaaaacctcatcgtccccactaaaaatacaaaacttagccgggcgtgatgggaggtgcctgtaatctcagctgctcaggaggctgaggcaggagaatcccttgaacccgagagatggaggttgcagtgagtcgcgattgtgccactgtactccagcctgggcaacagagcaagactctgtctcaaaaggaaaaaaaaagagagagagagagagaaaagaaaaggctcacgcctgtaatctcagcactttgggaggctaaggcaggaggagcttgagaccagcctgggcaacatagtgagacctccttatctctacaaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcctgtgtaaattaccttttgacatcctttgtttattttggttggtcttttacctcgtcgtcatcttactcacttttaaagagcatgaattaaggccgggcacagctgctcacgcctgtaaccccagcactttgggaggccaaggtgggtggatcacctgaggtcaggagttccagaccagcctggccaacatggtgaaaccccgtctctactaaaattagccaggcgttgtgatggatgcctgtaatcccagctacttgggaggctgaggcagggagaatcacttgaacctgggaggtgaagattgcagtgagccgagatcacaccactgcactccaacctgggcacagagagagaccccatctctaaaacaaacaaaaaaccacagtatgaattaattatttctctcttacatgttgtagaaatttttcccaaatctaccattcattttgtaaacataaactatatttctgtactctcttatagtaattgtagatttctagtgtttcacttggtttttgaatcgacaacagttttgtgtgtagggtattgtagtgtaagggatctgttttttcccccaggcagatagctcattttcccaatgcaatattcctttaaatattctgaataaaagaaaattttaaaaatcatttttgagcgatgggaaatgtgaaccaaaaatatgcataaggaatttttgattgaaaaacccagacgggggcaggagtttgaaatgaacttcccctaaaagccaaaacttgtagaggtggcagcctgagggctttccagagagctgtaattgactgtttctcccatcagccactctcctctttctcataacttttttgggcagccattaaagatctgatgacgagtgtgaatgtggcagcattttggcattttggatggtggcataattgcacatattgaaaaactctaaatttacatcggtggatccagtgcgtctcattatactggaggtgtgaaaactccatgtgcctctttgaacaattgtcctgctctgtcacagttcaggggaaacaaaagtagctccaacttcccgagatttaaatttgactttattccatttagttgatattgtaactagaatttgaatagtcttttccctttctgattttttttttttttttttttttttttttggagatgtagtttcgttcttgttacccaggctggagtgtcgtggcatgatttcagcttgctgcaatctccacctcccaggttcaagcagttctcctgcctcagcctcccaagtagctgggattacaggtgtgtaccaccacacccggctaatttttgtatatttagtagagatggggcttcaccatgttggccaggctggtcttgaactcctgacctcaggtgatcctcccgcctcggcctcccaaagtgctaggattacaggcgtgagccactgcacccagcacccttcctgatttccatttccgcttttatctctccactcccgaagatgtatcaacccacaaggaacttccttccagcccttacttaaaacattgctctttttccagctccagatattccctacattggctgccactcctccttgtctctgttcagtcttggaaaattggtttggtccaagctgaagctattctttgaagaaataccattatttttaaataaaaggattccccagcctggacagtgtagcaagaccccatctctaccaaaaaatcaaaactttagccaggcatgatggtgcacacctgtagtcccagctatttgggagggtgatgcaagagaatggtttgagcccaagagatcgaggctgcaggttagctatgatcgtgccactgtactccagcctgggcaacagagtgaaaccgtggctcaaaataaataaataacataaaaagattctcctttgagagaatcgcttgaacccaggaggcagaggctgcagtgagtcgagattgcaccactgcactctagcctgggtgacagagtgagactctgctcaaaaaataataataataaataaataaaaaagattcctccttccaggagccaagaactaggaatttcaagctgcaatcttgctttttaagcatggttatatatggggggtcagcagaatgtgtgaaaattattgaaaagtaaagcatgagatgtgactgagctcttgagagcagaccactttccccttcttaaaacgttttttttttccctgacccctgtctgagatacaggctctcctggttcggcccaccttgcccatcactctgctgggtccccactcgcgccctgcacctgaggttagagggcacataagtctcggggacctgccctttgatatctacaagaccctgtcctcaggggatcccatcgactctcgtggcttaaaataccatccacagaaggatggcgtctatatttatattaacccaaatattcaactgaatattcaacatctctacttggaaagacatctccggcttcacatggcttcaaaagagaactgttgacccctcccacacacaccgcctgcaccaccaatcccagtccccctgtcacctcgggaaatggcgtcaccacccaggggctgctcaggctaaaacctaggtgtgccctggggctccccctcctctcccccgacatgcctggtccaccagcaagcccgtccttcctcctggatacacctgggctcccagctacacgctgtcaccttggcccaagccactgtcatggccaccccaccaccacttccgttcttggctgccttctgtccattctctttccccagcggcctcagttttatttctaacgaatgcagttcagatctttccgtctccctgctagaccctctgatgtctttccatccaaccttccacattctgtgaccccacgtcgccctcactggctgggccacggcccctctagccccggtcttcacccttgaacctgcctagcctctgtcctcctcctctgcgccccgtggcttcttccactttcttccacctggctcacccggaattccagctacttgtgctcttcctgtcacacattgcctggtgtgtcatttccatctctgtctacctttccctcctagaatgccattcccatgagagcactttcaggccacttcacggcgtacgtccagccccaggcacagagcccggggtatcataggtgcacagtaaacatctgttgatgggctggctggattctatgtgggaagcataatgaccagtggtcacaaattactggggccagaggggcgctgcctggtgttaaccgcctggtgcctgccctacctttaaagccaagagtgtccatttaatgagcaagaagcagaaatcctgggcaagcagtgcagatgtaggctctcgggaacatgttgaccactcagaaaaccttccaggaggtgagtaccaggagatggaggtgctctagactgtgatgctgggaaaggattgtgggctagaaaaagggctccctagggccggcatatgggccactgggtggaagaggggctctgagaccctcaccctggagcaggtcatcacccacaccgaaggaatgaagcgtgaattcggtcacgcttaaaatgttgaattgttggcaaaagcccaagttaatgaaatagcatggaaaatggatgtgatgagatttttgaattgtaattagattaacattgtcactagttatcagtctgatatatcttataaatcaaacgttgggttgatttatcttttatcacttctagggacttactcctaacagtaactcacaaaccagccccaaatcagagctggtaggatgggctcccagctatctttaggaggtttgttggtttggggaagacagctcccccttggcagggctcaggtgttttctttcttttttcttttttttttgagacggagtcttgctctgtcatccaggctggagtgtagtagcacaatgtcggttcactgcaacctccacctcctgagttcaagcaattctcatgcctcagcctcccgagtagctggcactacaggtgcccaccaccatgcccagctaatttttgtatttttaatagagatagggttttaccatgttaacaggccaggctggtcacgaactcctgaccttaggtgatccacccgccttggcctcccaaagtgctgggattacaggcgtgagccaccgtgtccggctgggtgttttatttcttcgtctgttattcaggaactttgtttccagcgctgtgagtatgagtacaggcccagggctgggtgacagagtgcggagagcggggccctacccttgagctgtttctggaagggctcccagccagcaccgggcttagggagcagtgccctgcagtgtcattctgggccagggaggttgtgatgaatattattctcaacagagggtccccagggcagtgatgccactactcaggatcttacagaagaagaaccttcaggctgggtgtgggggctcacacctggaatcccagcactttgggaggccaaagtgggaggattgcttgagcccaggagttcgagaccagcctgggcaacatagcaagaccctgtttctccaaaaaaaatgtttaaaaagtagctgagcatggtggcatgcacctgtggtcccagctactggggaagctgaggtgggaggattgctccacccgagaggtcgaggctgcagtcagctgtgattgtgtcactgcagtccagcctgggcgacagagggagaccctgtttccaattaaaacaataaaaatcttcattttgaagaatctgaccagttctctacctggcacttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccgagaaccagcccgccgtccgcacggatgtacctggaagccacagtgccccacaccccgtgggactttctcccgaacacagcacctgcgcttcctgactcctctctctgaatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctttttttttttttgagacggagtctcgctctgtcgcccaggctggagtacagcagtgcgatctcggctctgcaacctccgcctccctggttcaggcgattctcctgcctccgtctcctgagtagctgggattacaggcaagcaccaccacgcccagctaatgtttgtatttttagaagaaacggggtttcaccatgttggccaggctggttttgaactcttgacctcaagtgatctgccgccttggcctcccaaagtgctgggattacaggcgtgagccaccgcacctggccaggtttcaagtcttgactctaataaaaccagggaggtttcgctcagccacataagtgggagggaaaattaactgttgctttctgtattcaccaagatggcctaaaataagcaagcagaaaagggaagaaagaaaaccaaacccatgaggttgtccaagtcgatcttggcaggtattttcttgcctgttgattgctagagtttccctctacctgcattgcaggctgaaatgtatgactcagccctgaccaataacatagcagtaaaaagtagtttcccctgagagctttctcttcctccatagctgtgactgctgacatcttccactgtaagtgagaaaagttgagtgtgccctgctgcctcgtttttctcaccaaggtgttatgagctggtagggaaggccaggagctagggcagcagctttagaattagtgcaagagacaggaggacaagtcactgggtctcctgaatttcctcacctgcaaaacagggacagtttttaaatttcttttttttttctttttttcttttttgtttgagatggagtcttgctctgtcgcccaggctggagtactgtgttgtgatcttggcttactgcaacctctgcctcccaggcttaggtgattctcatgcctcagcctcctgagtagctgggattacagatgcgggccaccatgcccggctaatttttgtatttttagcagagatgaggtttcaccatgttggttaggctggtcttgaactcctggcctgaaacgatctgcctgcctcggcctctcaaagtgctgggattacaggtgtgagccaacagggacttttttttttttattatactttaagttctaggatacatgtgcacaacgtgcaggtttgttacatatgtatatatgtaccatgttggtgtgctgcacccattaactcgtcatttacattaggtatatctcctaatgctatccctcccccctccccccaccccatgacaagccccggtgtgtgatgttctccttccccaacagggacagttttaatcaatcccctttctgggtggtgtcaggacacccacagaggtgtgggtctaagcgctttgtgagtgtccacgtcctgtgcctaaggaaagcactagtcattcattcattcacccaacagttcctgacggcccacctcaacaggaaggaatattatacagccactaaaatgtaaaatcaccagtgctgttcagaaggacggagatgtttatgtcattggctgtgtgaccaaaagaaaaagttctgctggggatgtgggatgggcatatacgtgttttgaatataagatctttctttaatgctgttatatttggtctccataaaataattattctttgggtgacaacctcttagaaaaagaaagacaaaagcagctatttgcataaacctcagcccaggtgtggtctccagccccaggaaacttctctaacacccctcccatcctcccaccagtggttcctccctcggtggcatgaggtggttcagtttttttcctctgtgcccaccctggggtgccctgggcccatggccactgactgcagtgaacaattatgtgtgagtctgttagttcatttgcattgctataaagaaatacccgaggctgagtaatttatgaagaaaagaggtttacttggcccatggttctgcaggttgtacaagaagcatgacgccagcatctgctgctggtgaggcctcaggaagcttccagtcatgatggaaggcaaagaggacttgacatatcacatggggagagagagagtgagaagggggaggtcccagactcttttaaacaaccagatctcacaagaactcagagcaagaattcactcattaccaggaggtgggcaccaagccattcatgagcaatctgccctcatggcccaaacacctcccaccaggccccacctccaacactggggatcacatttcaacatgaaatttggaggggacactagccgggtgtggtggcatgtacctgtaatctcagttactcaggaggctgaggcaggaaaatcgcttgaacccgggaggcagaggttacagtgagctgagattgtgccactgcactacagcctgggtgacagagctgagactgcaccactgcactccagcctgggtgacagagcaagactctgtccccccccaaaaaaaaaaaaatatatatatatatatatatatatatatatatatatatatacacacacacatatatatatgtgtgtgtgtgtgtgtgtgtgtgtgttaggggacagatgtccaaagtgtgtcagtgtccatcatggctattagactgtcaggcattgaatatgggcccatgttttatttctctttatttcctcattgttgaacacatgggtgtgcctcctatggatgggaccagtggctgactcacctttccaaacttgcatcctgatgatctgtaaagtgtacccaccctgtaagattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttctgtccacgatcatggtggcagctgcaaggtagtgcctgcaggactgctgtgcatgtggctgtttgacaccatgccgtgctgcaaactccacatcttcctagaacaaccaggagaatgccgtggagacttgttgccagatttttgcagttgccctgcagtggagaggttaagagcttggactccggagccaggtggctgggccactttgggggaagtttcccaaattcccacatctcagtttcctcatctgtaaaatgtgcataagagcaaaagccaccaccctgttttgaggattcagtaaaaccatccctctaacacaacactgagcccagtgccgggtatggtgtcagtgtctgccaggtaatggtgtaacgaaaattacaaagcagattgatgtggtgtgattcttgacgttacaaaagcttccttgtttttcagagggagttcccacaggggttctttagacaggcagtgcattaaggttgcagaaatttactttccagaaggttttaaaggaacgcagcttcaatggcagcaaggtacctgaaacaggaacccttccagagtgtctctgttttgttggcctttgagacctgccgcttctgactgcggggacctgggctgccccagatctgtctgtcagaagcctggagttgttaagctggtgaaatttaacaccactgtaaagagcccctcacagacaattcaggaacgcttacagatagaaaccggtcctggttttaaggtgtaattttgcacaagtgttaacaacaagagatggaattggtaacgaggcactggggtcggatcttcatatttttgtcacatttcatcggtgagatcagtaggtctgtctcccctaagaggagtgtggaatttagtgtttttccttttttgggctgtgacccaagagcttgttttcaagatatgtatttatttagaatacaaggctcttttccataaggaaagaaaatgttacagaaatgagctctcagttaattgaataagaaacctgttcgtctcatgactcacttaagagagagctggcagcccttcctgaatgcctattacaggcggcactgtgtccttttacttaatcttcccaaggaggatgagggttgcaggctccccaggcccatcgctgtgttggtgagtgacagagcctctgtaaaggaatggggatgagctctgagcccttttcccgtgggctctgctgcctggaggcatgccctccctcggcttgtcttccagctctcgcacagaaccaagtgttaactggtggtggtttggagacgagaggaaatggaccgtaaggaccattgagttggcataaggagaccagggcccaactccggaccctaccagagcagagtctttctcctctgtaatgtgagactgtagagctctagaatgttccttctccaactcagagctgatgctgtcagggccctgctgcagggtccttcagtggctccctgtggcctgaaggacaagccagctcctgccctggaagccgtggggatgtggtcctagcctgtgctcctgcctcgctcacctccctggaacaccagggccacctctctgggctcctcctgtgccccagtctgctcctgccacccctgtcccaccgtgcttcctccctccctgtgcctcagctcaggccttgccacctggagctctgacctcgtccgtcttggaatgaggcacctgcatgggtagcccatgggtagagttgcagtcatctgtttgctttcgattcactcccgcatcccgacacagtgcccagcacatcatcgatgaatgagtgtggggcaaatgcttgcacagaagtccgtgcgtgagccacgacggtaaacagaggcgctcctcttgtcctaatgtggaactccccaagctacgggaaaggggtgcatatggaccgctgctcactcacggctcagatacttccacggtaatgggttggcgacagtgactcagcttctcataggttcaagcggaagaaatggtgagtcctggagcactgcttgctttgaagtctgtttcagactagggtcatgtttcaaagtttttgaatttcttttttattcaaaagacatttgatgagttgactattgggggaaccttgaccccggtgactccgtgggacaggggatacccccggggtcccttataagcctgctgactcaccgcctgttctccatcttctgtcttccacattagaagcaagggcggggacattgcctttcccggccgctgcggtgtcctggcgcagggcacgtgcctgagggcccttggtcatccgagggaggactgcaccagggacatcagagtgctgatcttacaggaaacggcaaatgaatggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagactgaggcaggagaatcacttgaacccgggaggcagaggttgcagtgagctgagatcacgcactgcactccagcctgggcaacagagcgagaatctgtttcaaaaaaaaaaagaagaagaagctgttctccgtgagtcagccccggtgtctgataagtgtctgcagctgacagctcagagctggtgtcaacccactttggaggctggggtgggaggcaagaaacccagacagaacccctcctggctgcaaaacctccaggcttaactgtggcgcccactccatggtgggtcttaactctcctgaaaacacttcatgggctgtgggcctctcgggtgcttctgcgccagctcttcctcttcacctcctgccacagatctgtgtccccaggctctcctgtgtgtctccctgctcctcctttccctccaggtccgattccacagccctgggctgcctttccacctctgccttctctggggtatgtcctcgcctctcctgtcaccattgtcctcagggatcttccagctttccaggcatttggaaagaggcctccataccttgatgtggcctcccaggttccttgcgacagagtcctgcgtcgggataccaggggctgggcgcggtggttcatacctgttatctcagcactttgggaggccaagacaggaggattgcttgaggccaggagtttgagccagcctcggcagcataatgagattccatctctacaaaaaaataaaatttagccaagtgtggtggcatgcacctgtggtcccagctactcggaaggccaaggcaggaggattgcttcagtcctggaggttgaggctgcagtaagctataatcgtgccattccagcctgggaaacagggtgagatcctgtctcaaaaaaaaaataataataataataataatatttgtaggggaaggacactcagatttcctactggaagcaaggcttcctcattccatcagattctgctcctcctccaaggctcggctcaggggcctgcccctccatgaaccttcccagccctcagcccccttccttcctattcccccagcaccgacgtcacctcatcctgcccgactctgtagcatgcaggcctccgtcctccacccagctgcagaaccggagacctcaggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgagccctggagttcaaggcagtagtgagctatgattgtgccactgcattccagactgggcaacagagccagaccccatctcttttgtttgtttgtttgtttgtttgtttgttttgtttttttgagatggaatctcacccaggctggagtgcagtggtgagatcttggttcactgcaacctccgcctcctgggttcaagcgattctcctgcctcagcctcccaagtagctgggattacaagtgcccaccaccatgtctggctaatttctgtatttttagtagagatggggtttcaccatgttggccaggctgatcgtgaactcctgacttcaagtgacgctcccacctcggcctcccaaagtgctgggattacaggtgtgagtcaccgcgcctggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagatatgtatttccgcatctttacggagtctcatcaacgctttttaaacctcccctgggatttgaaccagcgcccatagatacaggtggcttgtcaggtcagctaggtgctgctactgaggcagcatctgtccctagccccgcacccacaggttcagaaggggaacgcttcccccgggtggcttatgagatccagtacttctagtttcacttctttaaaaataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttcttttttgattggggagactggtgtgcatagaagggaggtgtcagctaacgagactgttacctcaccacagatgcccacccgtgggtgatggagctcccaagtcctgggccacaccctacgtgccccatgcccagcaagttgggtgggggaggggtcagtacatgtttgtaagataaagaaaaacatccttcccaatcagccgtattacccagagggtgatactgatttagatcttatttcagtttggttagagaagctcaggtaccagtgagcagaagtctggccattgtggtggcttctggaagatgatgtgccatactgttagcaggggtgcaatttggggtgtgaggccaccagagctttgatttccgcccccgccgcccccctccaacccccgccccgccggattatttggagtttttttattgttgttcatggtaattacctgctattagacaacaatctagttccatttgcaatagggaataatacgtctgtgacacagtctccagacttagggagcctctggccaccccgagggggccctggtcattctgctgctggtcatgcctagctctgggtggccgactaggtggcctgggcgggagggtccactctttgcctttataaaaagaagggcttgggccaggcgttgtggttcatgcctgtaatcccagcactttgagaggccaaagcaggaggatcaccttaggtcaggagttcaagaccagcctgaccaacatggcaaaaccccgtctctactaaaaaatacaaaagttagccgggtgtgtggtgggtaccagtaatcctagttactcgtgaggctgaggcaggagaatcgcttgaacccgggaggtagaggttgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctctaatccccagcagtttgggaggccgaggtgggcagatcacctgaggttaggagtttgagacctacctgggcaacatggtaccccgtctctattaaaaatacaaaaattagccaggtgtggtggcacacgcctgtaatcccagctactcgggaggctgaggcaggagaatcgcttaaacccaggaggtggaggccgcagtgagccaagattgtgccattgcactctagcctgggtgacagagcgagactccgtctcaaacaacagcaacaaaaaaggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaattagccgggcatggtggcacatgccattagtgtcagttatttagaaggccgagacggggggatcatttgatcccgggaagtgaaggtgctgtgagctgcgatcctgccattgcatccagcctgggcaacagaacaagaccctgtctcaaaattaaaagagagagagaaacaaacatggcagctcagaaacctggctgggggtgattgtggggaactgctgctgacgggctcttgggcacacccctcactccagccattctgcctggatgccttaggaacactcctcataccctcctaagagtcccatccaggccgccatggctcacttatccctgccacgtggactccagaaaacattctcagtagaaacccacagaaactgttcccagtcacaaagcacgccaggtgcatcctgttctttctgtcatttaaaaaaatgaatgtgtctctatccctccttcttataaaacagtaccctctcaccctgcatggcttaaattctggtctatcttacgcctttggattcaatgaccttcatcaaatgtctgcaaggcaagggccatttacagtaaacatggtgggaacttagcaatgtacttgggaaataaattctggtcaccaaatagagaagcaaatgcaacaaataatcccacagaccattataaaatgtcttttagacgatagttgtcaagaattagagttactcgtccaaaactgttgttggtgtttggaagcatccaaacatcggctggcccatgtcccataggggcgtctgcttagcaccctggtgagtggagagttgtgtgtatggggacttagcagagtgggaagcagcttgcaggaaggttgccaacgcttattaatatttaccaaaaagatgcaggaccggctgcggtggctcacgacagtcctcccagcacttagggaggccgaggtgggtggatcacctgaggtcaggggtccaagaccagcctgggtaaaatgtagaaactccatctctcctaaaaatacaaaaattagccgggcatggtggtgcacacctgtagcccagctactcgggaggctgaggcaggagaatcgcttgaacccaggaggcggagattgcatgagatgagatcgcgccactgcactccagcctgggcaacaaagagcaaaactccatccaaaaaaaaaaaagagagagagatgcaggaccatctgcctatgttccattttggtgatgatatctgaccttctgggagagagaacatcttaccccacagacccaggaaggcatgcacatgaggatggcaggagagtggctgtggacacttcctgtgtcaccatcctctgctctaggtgtgtactggtcacaggcacaggacagaaggctccccagagtccgatcccgtctcttgagctcagctggctatcctggaaccccccaacccgctgacctttggaagtggacagcagcccacgcctgcaggtggtccggccctgctgtgcagccctgttacagcacgttgtgtttttctggcttgtctctgccaagccccatgtgaccatggagggggccccgagcagacctgggggtggcggtactgaggcagaggcaggcgcacagtggtttccaagggagaaaatgaattcatgatctaaaatgcaaaaccttaattatgcctgactcctttcctccctccctccctcatttctctccctccctccctccctccctccatccatccttccctcgtttccttccctccgtctttttccttccctcccttacttccttcctctcttcctcctacccttcattgacctttcattttgtgactttgtcaaatacagccccaggctatcttctctttctcctctgctccaggttgttttctcttgctcctctgccgcatacatacccttccaccctgcgtctgcccatggaaatctcgtgtcccctccagtattcctgcccacagtggcctttgttaggaaattccggcacagtctcctcacagggcagcccttctgggaatcgctcccctgcgctcgtgtgcactcccctgcgctcgtgtgcactccggcccagccttcagagctgcttacctggctcttgtcttgtgtcctctgaccgcccatcagggcctgcccatggggctctgtctgcaggggagcagccccaaacacagtccttgtcagcacgccgatctggacctgaattgggcccttgcacacactagctgtggaccgaagacaaatcaggttctccccgtccccagagtggggaaagcggtagtgtgggcctccctggggtgcccatgatggtgtaatgagtgcgtgcacggagcctgctccacgtctctatggacatttccataacttttcttttggtttgtttttttgtttgtttgtttgtttgttttgttttctctgagacggagcctcactctgtcacccaggttggagcgcagtggtgcaatctgggctcactgcaacctccgcctcttgggttcaagagattctcctgccccagcctcccgaatagctgggattacaggtgcccaccaccacgcctggctactttttgtatttttagtacaaacggggtttcaccaggttggtcaggctggtctcaaacttctgaactcaaatgatcctcccgcctcagcctcccaaagtgctgggattataggcatgagccaccaggcccagctaacttttcaatttataaacactaatacctacttgtgtcccgtggcctcatctcagccatgtgaggccgatgttgtgcccattgtacagatggcagagcgcagctgtgtgtgcagtgcggattgcaggactgtgcctgagtctgggacagggtctttgccacagctcttgggatcctctcttctcatcaatgttatctcagagagctttcactgttggataagaggttgaccctggaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgtgtgcagtgtggattgcagggctgtgcccggctgcaggaacacatttactggatgtgtgcagcacggattgtagggctgtgcgtgggctgcaggcacacatttactgggtgtgcacagtgcggattgcaggactgtgtctgagctgtaggtgcacatttaccgagtgtgcacagtgtggatttcaagacttagagatgagacagccagttcctgtcctgcccaagggtcgggcagggatacgcatcaaagaccctgggcatctttcccagcccgggcggtgcccccagccatcgcttctcagcaggacagccggcagggcatctgtcgtcttcgtccaccagcatcacgacctgtttgggggagaagtagtatttccacaccccactcagggcgatagcgtttgaggaagaagagaaagagagacttttggctttcctgatttcaatctttctgaaggtggacccatcactggtgaaaaaaattggtttttttggaaccaagaaagcagcctcggcctccagtgcctgaccaggctctggccagggtataggatcctggcgaggatgctgtgctgtgttgggcaggaagccacttcctccctctaaacgtcagtgtccagctctctcttcgtcgctttcttaagttgagggagctgctatgccaagggcaagcaagaaacaggcccctgagcccccaggttcacggctgggctttgaagcaggagtttcctcttcgccctcgggccacacctctgtagggtgcctctgcagcatttccctcctcgggcaggagcctagcttgcagaggacagacaggcaggaatgctggcctccatcgtgccaccagatcctgtccccaggcaagcaggaggggaggggaggcagtctcatcactgcagcaggaggggccacctctggagtccgcatggctgtggctgggctgtgcttctagaagcagcagctgtcgcctccactctctagggatttttatctttcctttacaaacttttttttacctttttttttttttttttttttttaagatggggtcttgcttgttgcccaggctggtctcaaattcctggactcatgtgatcctcctgcctcagcctcccaaagtgatgggattacaggcatgagccaccgcgcctggccgatttttatctttcctaccagccttttcatatgagctgagcctgcaggctgtgcctaagcatagccctttgaacttgattgaccatgagctttgaaaggctgctttgcagtctcagttctctggcaaatacaccagctcggttaagacgacttttctttgattgatgtcggctacatctagaaagcaggattgccaccactcctcgaagcaccccacgattagagtgtctgagcgctgcttctgctctgctgaggctggtgacaaattgcctggaaagacctcctgacagaggatgacgggctcgtctgcagcagggccgcttgcagcccaattgcttccaagattaaacctttccaaggcagtctgcactgccccatacacagttgggctgcttggtttaagattatggatgaatgtactgaattggatctcatttaaaaatatataggttttgaagtttgagggctcaggaagaaaatgaaatcctttgtcccaaaccagggcctggttttatcagtggcatgcgtgcgtgtgtgtgtgcgtgtgtgtgtgcatgtgtgttctaaagagaccctagtggcaaggcacagtggcttatgcctgtaatcccagcactctgggacgccaaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactcatgggcctcaagtaatcatcccaccttggcctcccaaagcattgggattacaggcatgagtcaccatgcctggccataggggaagatatttttaaacaagatttgcttttgactagtgtcctgcatttgttaaagaccctagattgctccaggtgttctaaaaataaccaagcccacctgcctgccttctagatatgggctggagggcctgccaggagcattcttggggattgccagtagccccagttagcccaggctgacttacacttcctccctctcttaaccaaaataatgttgaatttttgtgttccttgtcttttaactgaaaagctcctgtttgtttgtttgtttattttctgagacagagtcttgctctcttgcccaggctggagtgcagtggtacgatctcagctcactgcatcctccgcctcccaagttcaagccattatcctgcctcagcctcccgagtagctgggactgcaggtgccctccatcacaccaagctaatttttgtatatttagtagagacagggtttcaccatgttggccaggctggtctcgaactcctgacctcaggtgatccaccgcctcagcctcccaaaagtgctgggattacaggcgtgagccaccgcgcccggccccgtttggtgtttttaatgctgtattgccattatttgcacttattcttttgcaaaatttcagcacctggtggtcaggatgttcctcctggccatgcacatgcaggacacacaacaggttcttgataagcgtgtgctgagcaaaactcactccttccttctggacacattcatcacaggtgtgctcgaagcagcaagagcttgcccctgctcagaagtgcttagttgctaattagatgtttccgcaaaggtactgaaattggaggcatcagtgttcatcctttagctatagcgttggaaaaatgtgattgatttacaactgtgactaaaaaggtgtttagagaactgttctatgtaaaacaagacagtaagctgggcacggtggctcgtgcctgtaatcccagcactttgagaggctgagatgggtgagttgcttgagctcaggagttctagaccagccggggcaacataacgagacccccatctctataaaaatatatattttttaaaaagctgagtatggtggtgcatgcctgcagtcccagctactccagaggctgaggcaggaggatctcttcagcccaggaggtggaggttgcagtgagctgtgcttgcaccactgcactccagcctgggcctcagagtgagaccctgtctcagaaagaaaaaataaatatatatagtgtgtgtgtgtggttgcaacttttgcacatcaccttgagttctgggcaaggggagaggaactgagattggtcactcccttcttgcgtggatggctgtgggatttgggtgagttttttgctccatagtgcttttcaccctgtattttctcataggttttgccccactggggctttgtatagagattggggctctcaggtcccatatggcacttactagcgagagttccgagtggccagtcccctccctgccctggcattggtacaagggggccttgctgttggaccacagtcttccaagagtccagctcccctgttctatcgagtctgaagcaaggtcccacttgggagttacagatcaggctcctttgatgtcagagcatcgcagcggaattctaggccacccggcagtgagtgctctctgcagatctgtgagtggtgctgggccgccctgccacctccatccctagcaccgtatctgtgtgaaaaagctgtgacctgccccttgggtggaagccttccagtccttggaaggggaatctttgctgctgctactgtctgcagagagactctttttatttttatttatttattttttttgatggagtcttgctctgtcacccaggctggagtgcaatggcacaatctcggctcactgcaacctccacctcctgggttcaagcaattctcctgcctctgcctcctgagtagctgggactacaggtgcttgccaccacacccagctaatttttgtatttttagtagagacagggtttcgtgttggccaggctcgtctcaaactcctgacctcaggtgatctgcccgcctcggcctcccaaagtgctgggattacaggcgtgagccaccaagctcggcccagagggactctctagagaggccccttgatcccacaaggggcgggggtctctggccaggcacagcccctccccactaagcccagcacctggtgccgaacacacacacacacacacacacacacacacacacacacacgcccgccccccgctccactgttctgttgtcagttgtgttcgttgttttcttgtaaataaacagtatgacaataaagggaagttacttcttagctgctcagaaggtgaccagagcagggctggagtgccagccttgcattcattgtttgctttattgcaaggctgcttggaattgaaggggatctccgttcgagtctgagctggaggaaggaaggggctcctgtaccatgtatagaacttgggctctccccggggtcaggggcctgggctctggtgcagccccaccacttcatcaggtcaccccaggtggtttcagcctctgatttctcatccctggaatggggtgtttgcagcctcgtaggttgctatggggattgaatgagatatgttcatgagccagtaaggcagccaagatgtcacttacatggaacttacattgcaaccccagttttagaataacataggatattaaatatcaccatctccttgaatactcatagtccgcagtttgcttcatgttataaggtgtttagttctaggctgagcctgtaatcccgccactttgggagactaaggtgggaggattgcttgaggccaggggtttagaaccagcctgggcaacatagtgagacccctgtctctacaaactatatgtatacacgtataaattttataaagatgtttagttgttctgaatttcctaaaaaatacagcttaacttttttgtcttcctttacctgcacctggatgcagtgggaaagattttcccagtagcacaaggtggaccaggtgagctatcctcacccaatggggctgaaagacagggctttgatatcctgccccagagcccggctgttaccacatggtttgatttgcgatgccaagcaggcttccttacgggtccacacacctctggtttttagcttgagattggggcagctgttcctcctctggcccagccaggtataatcaggtacaaaggaaagtgacctagaatgaagaggttgccctgacctggtggtggaattggagcctgggagcacgggtcggatggcttagttcatctgtttggcagtggatcaaatccccctcctcccacatacttgatttatgtggactgggaaagaatgttgggtttcaacataaagaaaacaaatttggctgataactcgtaaatcacaataaactttcattccaagagtgttctgggcttctaagaaatatattcctatctcacatctcagttgatattcacagccaccattgagctagagtcattcccaggtggagaaactgaggcttgggagttatgcctgccttggagagggatggggctaagacttgggctctggtgtcctgaccaccgagcctggttccttccacgtggtctgattcctgggatgtgaagcagccatcctcacagggccacacacctggacaggtacacagtgcagcaagtagagaggcaaagaaacaagggaattgatcaggggtccacacgctttctctaaaagagcctggtgctacatatgttagtcttgacggagaaagaggcaaaatcaggatatcatgtaggcacttatataaccactttaaatgcaaccatttaaaagtgtaaaaaccattcttagctcatgggccataaaaatcccagcagctggctggttttggccggcttgccgcagcttgctgacccctgggagagagcatctgctgctattgcaggcaggggactgcaggtcatccccctgtttgggtcccactcctgcccgtcattcaggctctgtcagcttctacccagaagtacctgggagtcgggggttttgctgtgtcacagagaacttggctctcgatagagtcggaaaggaattctgggaaaactctagagatgcattaaaaaatctccactgggccgggcgcggtggctcacgcctgtaatccctgaggcaggcacattacctgaggccaggagttcgagaccggcctggttttttgttttgttttgttttgttttgttgagacagggtcttgctccatcatccaggctggagtgcagtagcacgatcatagctccactgcagcctcgagctcctgggctcaagcgatgctcccacctcagcctcccaagtagctggaaccacaggtgtgcaccactgcacccgggttaatttttttatttttgcagagacgatagtctccctatctttcccaggctggtctcaaactcctgccctcaagtgatcctcctgcctcagcctcccacagggctggggttatagacgtgagccactgcacctggcctctttcttcttgaggctagttttcctgactgcgtgattcccaaagcttcaccccactgatgctgggttcccctcctctgtctactccacctgctgaggctggggctctcagggacacagtcagcagctcagcctctggaaagacctggaaagatcacatccttctgggaacctgcttctggaggcacaagtagtgtagctcctcttaggccctttcgatgaagtaagagcagctcattagcatcccaggctacaaagcctaaaaccctttgcttttaccaaaaccagagggtctaaagagaaaggtcacgaggagcgagcggccgcgtggatgaggttggccagagaaactggtttgttttggaagccgatggaagatgcgcttggaaggctaaggctgccgaggttgaagtccgtcattctcagtgcagaccctagggaggaagtagcaggaccccagtggggctgcaggcattcagaaagagagctgcctggggtttcccttcagaacctccctccttttaacccgggagtaaagagaaaaagacccgcggggtccactggctcggaagtcggtctctttcagtttggagcctccagttggaaacctgccttttaatggccaggctgatggtctagttactctttgaacagggaagcctcgtcaggctctctgctgaccacgcctcagtgctccctcgaaggacaactctggaatgccagtttttatctcatctcggtagaatggattttttttcttttcttttcttttctttctttgagacagagtctcgcgctatcacccacgctagagtgaaatggcacgatatcggctcactgcaacctccgcctcccgggttcaagcaattctcatgcctcagcctcccgagtaactgggattacaggagcgcgccaccacacctggctaatttttgtatttttagtagagatggagtttcactatgttggccaggctggtctcaggcgatccacccgcttcagcctcccaaagtgctgggattacaggcgtgagccaccgtgcccggccctagaatgaatttttcttttagggaaaataaggttattggtgaatgggtttgggctgtcatcttcagaaactgatttcatctagaacagtttgtgacgggcagatgtggaataaaaccactggatgcatcaggcgtcactgccaagggtgcaaggggctgctccatgctgggcgtgcgagaggagcaagaagccgtccccgcccaccacggtgcaggccgggatgcagcggaaagcccttgcttcttagatttcccacacaaaagtgtatttcttgtagatttcgccagcgcgggcctcctcctctgcttggcagtggctctgcacgagctgccttgggatggatctctcatctttgctgctggcctcatccaaggaacagaccccatgcacggagcctagatgccccgaggtcttcactgatggccctctgaatttttattttgtttgtatttcatttgttactgattgaatttttgagacagggtctcgctctgtagcgcaggctggagtgcaggggcgcgatcctggctcactgcagcctcggcctcctgtacctaagccatggccctctctgactttgaacccctcagttcattctcagatcagaccactcactcactgaggccctcggctcttccacaggtctcagccttttgccccttatagtttttagttgttgcagcctttctgttctcttcccctctcctgttaaggggacatttccaagcaccctggccacagaacctcctcacctcccaccctccgcccctgggtgccagggcctgggttctctgtggaagtcctgccagctccgggtatttcccacgtggatttctcatcatcttcaccaccagatcagttcctggcctgcacccctcctgtctggcttgtggcaggggctgccaccctcacctgggccctaaacttctacaaagccccactctctcctgttcccgtcagtctgcttgccaagtccagtttattttaattctggggaacgttgtcttcctcctcccccctccctcgccaccacccacctctggtgttttttttgttttgttttgttttgttttttttgagatagagtctcactcttgtcacccaggctggagtgcagtggtgcgatctcggctcactgcaacctccgcctcctgggttcaagcgattctactgtctcagcctcctgagtagctgggactacaggcacccgccaccacacccggctaatttttgtatttttagtagaggcaaggtttcaccatgttggtcaggctggtctcgaactcctgacctcaggtgatctacctgccttggcctcccaaagtgctgggattacaggcaccacttctggttctgttaccttcgtccaaacttgtatttcccagctggtatcttccatctccaggctttcccctctggcctgtcctttagcaggagtcaccttcctgaagcagaccctggtctggtctctgcgtactaccttttgcatggttggtggccgtccacccgcctctcaggccatgtctgggttcttctaggggcttcggtgatctgggagcctgtccccgctggccccctctcccatgtcttactccatcagcttcaccttgtttgtatctctggatctcctcttttttccttctgtttgtatcttgtctctttctagaaagcccccccacctctactcgcccctctgtggcaaatatcacccaattcaggtgcccccagcccagcaaagagggattttcattccttgggcccccgttgtaggctagctgcgcctgtctttcggcacatttcatttcctgcctggtatttcggtcgtgtgcgtgtctttattctcctcgtgtaatccctgaggtgcagagtgcgtgtctgtcctcctctgccctctctagagattgggatatgaccagtgttcagcccccaaccaaaagagcctaagaaccccaggtccccagcctgtcctgctctgctgggggcccacatgcctggggacaaggcacctttccttccctgaccttgactaggacaggacatggggtagggcctgaacattgagcaattgtcaaactgcctacttacgatgaacaaaatagcttttcaggaggcgagaccacagcacagtcatggtgaatcctgatgcgcaccccaggtcttttatcaggatttttgtttttcctggtgggcacagatgtaggtggagcagatcagaggcctctcaggttcttgatcactcatggcagttcaggcctgccagtagtgaggtcagagatccatacagcaggggagagaagggaggtacagggaaccctcggccccgcgtgctccagcaggtctgcatgattaacctgaattgcagtgttcagaggctcggcctgccagccacagcggttccagatgaaatgcagcttagaaggcagcatggtgtagtagctttggcgccagccgcacccagagtttggattgtagccagatggcctcaggtgcaatgtataacctctgggaattccagatttcctatttacacgacagggatgattccatacctgaagggctgtttggaagcatctagaagcaagcacagtggagtggctgtcatgacgctgaccgcacaaatgatggtgttaggatccctccacggatgtggccaggtgacacccctcacctaggccgcacagcaccctaatgtacacactgaagaaaggctgcgtggggctgcagagcggctcatttctaagaaggccaaagaaattgctcagtccagaccagggaacccagtttctcttttagaggtgggatcttgctatgttgctcaggctggtctcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacatacatgtgatgtacatacctgtagcttccgggaaagggaaggaagtagagatgacattgtctgttactcgtttgtatgtgtgtgtgcgtatttaagtaaatatgtgtgtgcatagggacatgtcacatgcatgtgtggcacatttataggatgaagaggtgtctaaaagacattgaggaaactcagtgaaggagttctgccggcgggcgtgaggaccacgctaaaagatgccggttgtgctttgtgtctaagctgaaagcatggatatcattttataaaagtaaaattatattggccaggcgtggtggctcatgcctgtagtcccagcacattgggaggccgaggtgggcggatcacctgaggtcgagagtgtgagaccagcctgaccaacatggagaaacccccatctctactaaaaatacaaaaaattagccaggcatggtggcacatgcctgtaatcccagctactcaggaggctgaagcaggagaatcacttgaacctgggaggcggaggttgcagtgagccaagatcatgccattgcactccagcctgggcaacaagagcaaaactccatctcagaaaaataaaaaaaaaaagtaaaattatattgttattgacggtctctttgttcgagtaagccgtctctggatatatcattgtatggtgtattcatgccaaggatttggtgtgagtcttgaagcattcacaccaaattgtggccaagcccagcactgagagcgcagtgggcgttcggaggacacgtttggattttgtgatcctctgcctggcaggagctgctcagcccctacagccccttccccgagaccaccaatgcgtttctcttcagttttgctattctcatacgctggtgatgggattttggagacaaacatggtctcttctgcttgcttgcttgcttatttatttatttttcctcccaggttcaagtgattctcctgcctcagcctcccaagtagctgggattacaggtgtgcgccaccatgcccagctaattttgtgtttttagtagagacgggtttcaccgtgttggccaggctggtcttgaactcctgacctcaggtgacctgcccaccttggcctcccaaagtgctgagattacagacatgagccaccgcgcctggccttctgccttttttggtgaactccctgtgggtgggagaactacccggtggagtcggtacctaaccagggcaggacacggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatgctggttgacgcttgaatttatttatttatttcagataattttggactacagaaaggactctttgaaagggtattctaaaataatttcacccaattaggttttaaacatagtctgccatattgttgatttcacaggatttgcttttttaaaaaaatgtattttatttatttagaatttttctttaagagatggggtctcactctgttgcccaggctggagtacagtggtgcgatctcggctcactgcaacctccgcctcccgggttgaagcaattctcatgtctcagcctcccaagtagctgggactataggtgcgtgccaccatgcctggctaatttttgtatttttagtagaaacggggtttcaccatgtaggccaggctggtctcgaactcatgacctcaagtcatgcacctggcttggcctcccaaagtgctaggattataagcgtgagccactgtgcctggccttcagtagcttttaaaggttgtagctgaagattttgtacttgtcacatgggggaatatgataatgaaagcagaagatagactagtcactctacttttcccagcgtcctctctgactggactctttgaaggtactgcccagggtcatgaagagatggccctggctgcttccagaaggtatacattcccgtgtccactctgtgtcctggagagtgggggcggggggagggggttgtccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcaccatcccagggttatgaatgacgttactgtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgactcatatgcaaacgcttctcatttcattttgttatttttttgagaaagggcttgttctgtctcccaggctggagtgcagtggcacagtcacggctcactgcaccctcgacctctctgggctaagccatccttccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaagaaaaaaagcatctaaaaattgtgaggttaccgcttagctctgtctttctggctgcacatgggttaccaggtgccttgccaagaccctgcctccgtgtccaccatgctttgtgtctgcaagtagatttacccatcgttcattattaattattcctctgagcagctctgtgaagctagtaaatattaataaacaatatgtgctgattatgaacctaagacaaaaggatgtctttttcaagctgcttaattttaggtaaactagttgcacacaagcgatgaataaacgtgaagtcaggcatccaggcggtgaaacaaaatcaaactggaactgcaaaaggagagtgcctgagatctgattttattttatttttgggatggagtctcactctgtcacccaggctggagtgcagtggcgtgatctcggctcactgcaacctccgcctcccaggttcacgcaattctcctgcctcagcctcccaagtagcttggactacaggcacacaccaccatgcccagctaatttttgtattttaagtagagacggggtttcactgtgttggccaggctggtctcgaactcctgacctcaggtgatctacccacttcagcctcccaaattgctggggttacaggtgtgagccaccgcatccagccgaaaggatacagtttatttaaagacaaaggaaaaagaaaaaccataattgtgttcacttagaaacatctcccatttcatactgatgtctttcctggtggtggtgtccaaatgcttatatgtgtgtgagattcattgttaccatgttgggatcagactgtaaacaagctttataaaagttcgtggctcctttcactcatccacccgctatgcatcgtccagatctgagttcacgtgctccttccccaaaggagccttctctcctgtctagggtcaggtctgcctctttttttctttttctttttttggaagcagggtctcaccctgtcaccaggctggagtgtggtggcgcgatcacgactcactgcagccatgacctcctaggctcaagcagtcctcccacctcactcccaagtagctgggattacaggcacatgccactacacgtggctactttttaaaatttttttgtagagatgggatcttgctctgttgcccggggtggtctcgacctcctaggctcaagcgatcctcccttagcctcccaagtagctgggacgacaggctcatgccaccacacccagctaatttttttgatttttagtagagatggggtctggttatgttgcccaggctggtgttgagctccagagctaaagcagtcctctcgccttaacctcccaaagtgctgggattacaggcacatgcccctgtgcccggccaggcttgcctcttaaactcccttcgctccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattacactgagccatgaccacacccctgcactccagcctggacgacagagcgagacctcgttccttacaaagaattatactgagtacctaatatgcaattgcattgctttagtagaattctctcataagtactcccctggtgtcggaatccacattgttcccagttgttctctgttctaaactcatgctgaacattcttgtgcataaatctctgcctacatctctgattattcttacggatagactcctgaaagtactaagaggaaggattaatctgcgttctgattttaaacagcccatttgtctaaatattagcagggcctaagatctggaataaatgacacagtggcaaaagtcggagtcacacgtcctggttggtttcagagagtcctggggtgaaatggtgcctttggggtccatccctgtctagcacaggagtcccctttgcagcagtgtccataaaacgttagcttgggctgggtgtggtggctcatgcctgtaatcccatcactttgggaggccgaggtgggtagatcacctgaggtcaggagtttgagaccagcctggccaacacggtgaaaccttgtctctactaaaaatgcaaaaattagcctgacgtggtagtgggcgcctatactcccagctactcaggagaattgcttgaacctgggaggcggaggttgcagtgagccaagatcgcaccactgcactccggcctgggggacacagagagactccatctcaaaaaaaaaaaaaaaagtgagcttggtgatgagtctgggaagagcatctcttcattcattcagtccacaagtattcactgtgtctgccccgaacctagcaccatcctttggcccaggaatagaacggaggaatgtacatctcctcaaatgtctcctagaaattgagacctcaccattctcgctaagctccctgagggcagggactgtgactgtctcattcactgctcgtagttaatgctcaaatggtttttgaataaattaaaatacaatatgtgggccagtgcggtggctcacgcctgtaacccagcgcttcggtaggccgagatgggtggatcacctgaggtcaggagtttcagatcagcctggccaacatggagaaaccccatctctactaaaaaatacaaaaattagccaggtatggtgacacacacctgtaatcccagctactcaggtggctgaggcatgagaatcgcttgagcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacatcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatacggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaaagaaaagaaaaagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcctggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatgctcagaatacacagagctgtggtggattgccagcagaagtgccccgtgtgtggttgcaacaggcaggttgttggcgctacggccttcaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcattctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacatgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatgcttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcacgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagggggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacggaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccagaacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctgcgtatgccccatttcgggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgatcgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactttgggaggccaagtcaggcaggtcacttgaggtcaggagtttgagaacagcctggccaacatggcgaaaccccgtctctactaaaaaaacgaagtacaaaaaaattagccaagcgtggtggtgggcgcctgtaatcccagctactcaggagactgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcagctgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggatgtatatatatatttatggggtggagcacatgagatgttttgatacaggcatgctacgtgtaataatctcatatggaaatggagtatccatcacctgaagcatttatcctttgtgttacaaataatccgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttgtcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgcgttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatatttccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacctactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcgtgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagtcacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggcggaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaacggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctcctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctggacagactctgctacccacctgcctctcttagaagagccccaggttgcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaacttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcacgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttatataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgagggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcgacacccacaaccactgcccagcgcatctcactcggatgaaagcagtgacgtccgagggttctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttgagctctttgtttttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatattgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttcttttattttttttttctaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaaatatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattggttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggagtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctatcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatattcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttctctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactcccgtctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaaaaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctattatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcgagaccagcctggacaacataacaagacctatctcttaaaaaaagaaaaaaaaaaagatggtgtgagtccattgtgtgttgctgtaaagaaataccttagtctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacactggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccattgccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtgtagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatctttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctgacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgcatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagggagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctctttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacgagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggcgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcgggtggatagatggatggatggacagacggatgggcagatggatttagacagactggcaaaaatatttgcaatatatatgagagagagagtgtgtgtgtgtgtgtgcgcgcgcgcgcgcgcacgccacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttctttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatcttttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacagggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccaaggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccaggctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaacaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccacttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacgtccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcacggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaactttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttaatagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcgcggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccgagtctgaattggcagatgttgggtctgtcctttccttgacggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaactttttttttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacgtgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcgtgttccacgggccatgatcagccatggattctctgaggaatatcccattgcagcccagacattacccgcacactgggccaacaggcagcatcatggagggaggaggacaggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgcgtgtgtgcgcgcacacacacactctcccccccacacacacacacccacacacgcacacacactcccacacacacactctcccacacacacactcccacacacacacacacactccccacacacacacccccacacacgcacacacacacactctcccacacacactcacacacacacactcccccacacacactcccacacgcactctccacacacacatgcacacagagtcccacacacacttctgcacacacacactcttccacacacactctcccacacacacactctcccacacacacccccacacacactctcccaccacacacacacacacattctctctccctcacacacacattctctcacacacacattatctcacacacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggaagcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtaagggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcatggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttgcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggtcaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagtattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccatcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatcttttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgggaggctgaggcaggtggatcacctgaggccaggagttcgagaccagcctgggcaacacagtgagaccccgtctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagcctttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagcttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacaacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcacagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacctgggaggaggaggttgcagtgagcagagatgacaccactgcactccagcctgggcggcacagcgagaccccatctcaaaaaaaaaaaaaaaaagaatgggcatcccaggcccttgagtggctctgccccagcccaccccacccccgtccccgccacacacacacacacacacacgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatgcaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacagggggcccttccctgcctggcagccgaggcagagagagagaggagacaaagagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattccgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccagccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggggccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttcttttttttttttttttttttttctgagacagagccttgctctgtcacccaggctggagtacagcagcacgatctcggctcactgcaacctctgcctcctaggttcaagcttctcctgcctcagcctcctgagtagctgaaattataggcacccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacagagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctcgggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcatggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagctcaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaa

SEQ ID NO: 779 - DNA, 24158 bp, Homo sapiens
cagcccagcccagcccagccccgcctcctacggccttccctagatcaggggccagggccaaagacctcccagcagaagaggagaagaggttgtgtgggacaagctgctcccgacagaaggtaccaggctgggggtggcagggctggaaggtcctggcctgggatgaagaggggactgcctaaggctggggtggctccaagatgctggcatgggaaactgggggtttcctggtaactggactcctagcaaactcccaaggattcaggtggggcccttctggactctaatcggcccatctctttccctttctgtgtggttaccaggttactggaggccacttagttgttggttttggttgggactttctggacttcagatctcagccctcgtttactcacccctgagccctccctgccctgcccccagcagttcctgacttcgcccctatacactgtccccggagctcttccctgggcctcaggtcctcaccctgcatcccctctgccctgcaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctggtgagtgtgacagcaaaatgtgtctggggtctcagggtggatggacttccagaggagcaggaatggggctcagtgagctaggtattgatggtggctggggtctgcgaccccagagaagcaagagagatggctcactcattcctctgctaactcactcattcctctacccactcactcctctacccactcactcactcctctacccactcactcactcctctacccactcactcattcctctacccactcactcattcctctacccactcactcctctacccactcactcactcctctacccactcactcactcctctcctcactcactcattcctctcctcactcactcattcctctacccactcactcactcctttcctcactcactcactcctctcctcactcactcattcctctcctcactcactcattcctctcctcactcactcattcctctacccactcactcactcctctacccactcactcaatcctctacccactcactcactcctctacccactcacacattgccctcctcactcactcattcctctcctcactcactcattcccctcctcactcattcctctcctcactcactcattcctctacccactcactcattcctctcctcactcactcattcctctacccactcactcattcctctcctcactcactcattcctctcctcactcgcgcattcctctcattcgcgcattcctctcattcactcattcctctcctcactcactcattcctctcctcactcttattcgtctgctcactcactcattcctctgctcactcattcctctcctcattcactccttcccctcatcactcactcattcctctgcccactcactcattcctctacccattcacttattcctctatccactcactttttgctctccccactcactcattcctctcctcactcactcattcctctcctcattcactgattcctctacccaccgactcattcctttcctcattcattcattcctctgcagttccatgccaaacctttctcacctccctgtcctcccacctcagcctgcttggatccttttcctgcctgtcttccctaccgtagtgcccctcccagaggctcctgtatggttgtggggtgcacagagcagggctctcctggcattcccaccttctccactgctggacttgaagccttctgagccccgatagacaggctgctccctgcatggcccatttgcttgtatctgcccatctctgggctgctgctttcccgcaggaattatctctgacttccttccccacggagggacacagctggaccagaagagaagtgcaggcagtctcccacaccctctccttccagggacaatgtgctcttccccagtaagatgtcccagtgagccctgtagcccaacctggatataatttggccactcccttcccctttcagaagccgtccttggtactcccaaacctttccctccgactgggaccggccctcccctttgggggatgtggcctctgtctgctcacttacaaaaggcaggattgatcggtgtgtccacaggtgcacaggaggcactagcacagaacctggcataagtgaggctctcctaggtgggagctgccatcctgatggacattagagtcacctctgctcccctggaggctgctgagaatggagggccctcaggacgcaggccctttgtctgtgggaggaaccagtgcccatgtggaccaaccaggacacaaaaggatatggcaaccagctctagggatatgtcctgaggccacactgctgcccacaaacctccttccatggggaccttcccatatagcaatccccagattgaaatcaatccaggatgagaaaacacatcctcttgagcagacagcttgtcttctctctctgctttggtatttacccttggatcttggggacagctccaagagagaaggagcagaagtcagcagaaacccactgcagctgctgagaatccagacacgctgctcactgcagaggctgcaccacatccggtggctgtggggggacttgctgtggcttcatctagggaggtgcattagtcagggttctccctagaaacggaatctccttagaaacagatagggtgtttcttcttatctctaatgcatgtatgtatggagacagaaagagatagagagataagaatttattatgggaattggataatgtgatgatggaggccaagaagtcccatgatatatcatctgcaagccagaaaccagggacactggtggtgtaaattcagcctgagtccagaaaggcctgagtccctggagttctgagggcaggagaagacggatatcccagcagcagaagagagagcaagttcttcctttcctctgccttttgtcctgttcatgccctcaatggattggatggggtctggcgtctcagggtgggtggacttccagaggggtgggacttccagtaggggttcagggagctgtgtattgatggtggctggggtctgggaacccagagaaccaagggagacggctcactcattcctctcctcacttactcattcctgtgcccattcactcattcctctcctcactcactcattctaataccaactcactcattcctctcctcactcactcattcctctcctcactcactcattcctgtgcccattcactcattcctctcctcactcactcattcctctcctcattcagtcattcctgtcctcactcactcattccttttctcactcattcattcctctcctcacccactcattcctctgcccactcactcattcatatcctcactcactcattcctctacccacactcattcctctcctcactaattccaataccaactcactcattcctctcctcacttactcattcctctatccattcactcattcctctcctcactcactcattcctctgctcacttagtcattcctctcctcactcaactcattcctcactcactcattcctctcctcactcactcattcccctcctcactcactcatttctctcctcactcattcattcctttacccactcactcattcctctacccactcactcattcctctcctcactcattcccttcctcccattcctttacccactcactcattcctctcctcactcactcattcctctcctcacttactcattcctctccccactcactcattcctctcctcactcactcattcctgtgcccattcactcattcctctcctcactcactcattccaataccaactcactcattcctctcctcactcactcattcctcccctcattcagtcattcctgtcctcactcactcattcctctcctcactcactcattcctctgctcactcactcattcatatcctcactcactcattcctctacccacactcattcctctcctcactaattccaataccaactcactcattcctctcctcacttactcattcctctacccattcactcattcctctcctcactcactcattcctctgctcacttagtcattcctctcctcactcaactcattcctctgctcacttagtcattcctctcctcactcaactcattcctcactcactcattcctgtcctcactcactcattcctctgctcactctctcattcccctcctcactcactcatttctctcctcactcattcattcctttacccactcactcattcctctacccactcactcattcctctcctcactcattcccctcctcccattcctttacccactcactcattcctctcctcactcgctcattcctctcctcactcactcgttcctctcctcactcgctcattcctctcctcactcactcgttcctctcctcactcactcattcctctcctcacttactcattcctctcctcactcactcattcctctcctcactcactcattcctctcctccctcacttattcctctacccacacactcattcctctcctcactcactcattcctctacccatgcactcattcttctcctcactcattccttcctctcctcactcactcattcttctgctcgctcactcactcattcctctgctcactcttattcttctcctcactcattcctctcctcactcactcattcctctcctcactcactcattcctctacccatgcactcattcctctccttactcactcattcctctcctcactcactcattcctctcctcactcactcattcctctcctcactcactcattcctctcctcactcactccttcctctccacactcactcattcctctcctcactcactcattcctttcctcactcactcattcctctgcactactatttccatcctgtttaccttcaaatgctaatctcttctcaaacaccctcacagacacacacagcaataatgtttgactggctatctgggcatcccttagcccagtctagtggacacctaaaattaaccatcacaggaagtgacagcccttgacttgctttcagatcactcctacagaggagggcttgaagaactcgacccagatgtcggccacctattcccagggctttacgatatggctgggtcccatcatccccttcatcgttttatgccaccctgacaccatccggtctatcaccaatgcctcaggtacccatgcagagcttgtggtggtgggtgccagaccaagcttctgtgtggtctctgcagtacccacgtccctccttgagtactcgtgcccctcattgagacttccttctcaatgtcttctccctccattgccatctgctccctgtcttggtgttctgggcaccactggggctccaagaggcctcaattcagggccctttctggaaggaacccccatgcttaaggacacgggtctagacagagacatttccagcctcatagggtcaggaatgggcaagagagagatgggtatgacaacacagagaactgggtgtctgctggggcaggctggaatgtttcctggaggaagagttgttggagctatgtctagaccaataagtaggattttttaagtgtggggcaggatgatgcagtgggcatcattggtatttggggtcccagccagtccttgcaccagccttgcccatccctcagtccaaagcggtaggaggatttgtggctggtggagaatctgggctgctatttatgtgacatccacctatgatgggtcagttccttctacctcatcctatcactcatccaccctaagtttcctgctctcctcctatgggcttcaggattctccaataggagaacccacaccagctgcttgacctccccttgctctctgctcttctcatccttggacacaccaggctgagctagggaagtggcagcatcccacaaaatctatggctctgacccccaaatccttagtgactctgtgcaggtcaccagctctctggctgctgaggtctctttcagttgtgagtgatggaaactcaacttcgtgtgctctaagcaaataaagagagtcaaaggagtgtaaatttcagggagggtggtcttcaggcatggctgaatccaggtgtcaatgaacattatcagggatctgtctccttttcttaatttcaccatttctctgcatcactttttcttttaaggcagccgttctcttatctgtcaaccatgggtcctagcagctcagttcttgtccgaaagctcaccttacccccaggggtcccataaatagccgcctatagtttcaatattatacctggttatatcttttctgtttaacctgggatcatatggagaagtcatcatgtgtgtggctcagctgtggtcgaggacacttggggcatgtcagagactttctggttcttctctgacatgtgatttgaaattgtcttttctcctccttgtcatctcttggccatgtttgtagcttgtccaaggtctgggagctagggtctctttggaattgtcagagttattattttagtctccctgagccaggtttcggaatccattctaatcacgcttgaagaaaactcttggttccacctgggacatgtctgggacatttaagaaatcacatttaaaccctatctggggcctgtctgtggggtacacagaggtcatgtcagactatctcaggtccatgtcaggagatgacagagagtgctatggcagacagggtgtccgaggtcctttaaaggtattttgtagagtgtggagctgtgttcagttgttgcagaacatgttgggatatataggagccatgtcaaggcgtgctggggtgtgctatgacctgttaggttgtgtcatagctttactgtgctgttgcagcctgggctggtccttcttcctctatcctcccttcgtcctttgcccttggcccccttcctgctatgctgggcatggagtggggaaagtgctggtaggcagccttgccctatacctgaagttcctctcttgccctctacatggcccctgatggtcctcgttcatgtcagctgccattgcacccaaggataatctcttcatcaggttcctgaagccctggctgggtgagtacctgcaggtgaaaggggttggggacaaccttgcggggagggtaggggaagtgctgctcttgcccactgtccttggctgccctactaggagaagggatactgctgagtggcggtgacaagtggagccgccaccgtcggatgctgacgcccgccttccatttcaacatcctgaagtcctatataacgatcttcaacaagagtgcaaacatcatgcttgtgagtcccttgaagtctgggtcccagatggagtcttggggtggagggaccatggacacatctggtctggaattttggctcttctgggtggcactgggccattgctcttcctctctgagccttggtttcctcatctgtaaaatggggatgataatccctacttgaaaggtcatttacttggcacacagtaggttctcagaaggtgtcagtttctgtgtttttctcacagaatccctgtaaactcaagagagtaaaaatgaagattgtgtagtagtcattgctgattataaaccacttcagaactcattggcttagagccataagggtttacaattgctaacgagtctgtgagacagctggccagttcttctggatgtggaagggatcactcttggcacatgagcagctgtgggtcggggggcagctttgctgatcctggctcagttcattcacgtttggggcttcagtaccttcagactcatctgggatgggctcagctgtgacacctggactttcccccatgtgattctctgcctccagaaggcaccctgttgttcacatggcagagactgggctccgagaaactgagaggaggctgcaatgtctgtggacattgtctctgcaatacttcaaagttcaaccaggtttgagtctattagagttattacatcatcatttcaccacattgtactggccaaagaaagtcgaaagtcaaaagtccagtacagactcaaaggggtgtaaaatagaacgcatctcttaatgggagttgctgaaaaattactgtggaaagggtacgaatacagggagaagtgaagaattgggggtcaggattttgtgaagtgtctaggatttgttttaaatatgcaaactgataagttagcttgttactgtctcatgcattctaacagattcctgggtcagagacaaagggtagttgattactcatggcacaataagcaacatgtacttcttgttggtttgtatcctttttctgagtcaacctaaattccatgggggtgacactggtgggcctctacattagcctgctcatgcagtacattgcatgacatacaatgggcattaggcttagggaatctactttaatagtggcagaaacaagcctgatattggtccaggaggagtcattgccttatctctccaggtggttatctgcaaatacaactctgagaaatggctcaggtaagaacatcacagtcttgcattggtggcatacgcagcaaggatgctcagggctgatgaagaagtgcctcttccaacacagggatatttttgaaatgaatttattacaatggagatgaataaagcaaacatttactcatcatatgcctgagaaaatgtcatgtcccaatgccaggatataagttgtctaagttaattttaataatcctgtgaggttatggttatttttgtcctattgcagatgatgaactgagggccagagagattagggagctggacagagttcaaccagccaggaagtgagctaggactggtggagcagagattctatcctggtttatctggccccaaagcagatcaccttgaccgttattgaatatttgacaggtgggacctagaggagggcaatatgttgaccaagggcacatagagcataggagacagagctgagacttgaatgcaggtctcttgactccaagccatgggtcttcatctcctatactaacagtttctgctcgcatcccagtctggtcctcgctggcaatgggttcctggggcagaggaccaggaggctggttgtgggggagtccatcctgatgtttgggactggggaggggcacaaaggaggcagggcccagctctagctctcttcccttctctggccaggacaagtggcagcacctggcctcagagggcagcagttgtctggacatgtttgagcacatcagcctcatgaccttggacagtctacagaaatgcatcttcagctttgacagccattgtcaggagtgagttccttcctagggcctgggatatgaatccatggaccaaagggagaaagttggggagggaggaatgagcaaagtaaccagaagtacctttcgggaggatttgtatcatagctgtgctttgaaggtcgaggaagaggagaaagtgctgtctttccaggtagaaatatgtgtgtaaaagcaagaaggttaggatgagccaagcatgtgcaagagacagtagaaatgaggttgtggaagtaggggctagatattaagggcactgaaaatcaggaaaagtggtatgaagtttatcaagacatttccagagaccttttgtagtttcagctgatgatggatgtgataagagctgagctgtgtgggaaactgatagcccaccaccacgcccagctaatttctgtattttcagtagagagggggttcaccatgttgtccaggctggtctcaaattcctgacctcaggtgatgtgccctctttggcctcagaaaatgttgggattacaggcatgagccactgtgcccagctgcttcttctttcttacagggtgaaagagagagggagagagagagagacagagagacagagagagagagagagaaagagagagagagttggttatgctgggggctggagcagggctgaactggaagaggatgaagtctgagttgtgtggacagttttggtaaggaaaatgatcagtactgcatactggatgggagacagaggagagaagcatggtgtccaagctatactctaggtgcctaggtgcatggagacagctctctcagagataggatgcagggagagaagacagtctagagagtcagtctcatgactgatacccaccatgtatctctaggaccatctatttctagatactcagtttcctgatgggaggtagctcctggctgctggtgggaggtgttcctggggctttgcatacgttacattgttgcctccctttctgcccttgctctgcaggaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggtaggtttctctatgatctgaatttaggtgagagaatagagcttcatgtcaaatgtcaggtgaaataaattggttttgatccaaagggcactgggagccatggaagatgcttgagaaagggaaggtcacagataggttttagagatgactttattgcatgcagcccacagggcactgctaattctgaaactgtgaggagcatgatattttattcaacttataagttagtgtgttagtctttcacatttttatgtgtatctatatgtctatgtctttgtctatgtctgtatctatgataaaagatgcaccaaacccctggatcacagcagcccattaattatttacagcagtaacagcaggtggagtaggatggtagtgctggctccccattcctagggcaacacaatgtttttacctgtaaatgcacaagaatttgcaccaaggagaggggcccccacattatgagtattatagcttatataggacagctagctcatatgctccttctttattacagggtgaaagttagagacagagaaagagagagagagagaatgctttgttctggcgtataaactacccctctcctgtgagatggcaatttctagagttttataacccaaatatcttctggaaagataagattctctgggtttaccactctagaatgtcagcaaatatttttggagcaatacataatttctaacctccaaggcaaattgccattcaaatatcctgtaccccaggttgccagtatctttttctctgaaagtctgtattatgcagaaaaatgaaaatattcgagaaccattgattcctgtcaccagggtccaaagaggaggcaaaggatctgggggaagcccttggagttggggctttggtgatggtgaacaagagagatctagacgtgcagagtgcatttgagtttctggaagatcagagcttcagagattatctcaggttagactccggagtctcagagatagtataatttgtgtgtgtgtgtgtgtgtgtgtgtgtgtgtgtgtgtgtgtgtcttgctttctcttcaggatgaagatgggaaggcattgtcagatgaggatataagagcagaggctgacaccttcatgtttggaggtgagggtcccagtgtgggactacagtggagacagaggtccctccatctcaggatccgggtgggtggaccctggatcactccattctgcccatcttccccctccctccatcctcctgagggcctcaatatctgggcgctgtccaccctccggtgctgaagccaagcttacctggctgctcctcaggccatgacaccacggccagtggcctctcctgggtcctgtacaaccttgcgaggcacccagaataccaggagcgctgccgacaggaggtgcaagagcttctgaaggaccgcgatcctaaagagattgaatggtgagtgcaagttcttctggcctgttcctgagcccatcattggttctgctccccaagtgaggaggggtggaggagttgttttgtggattcttccactattgcttagtgggtataaaagcagaggaccacaggcagggcttgataccaagcctggctgtcaggggaaaagttgcaggcctttaggaccgaaagacccgggctgctaagagaattggtgacaatgtgtgaggacagataatgctactttgcacatgttcagcaaatgaacttcccctccactctgtttctgttctcccagaaatatcagttttttcgaaaatcctcacttcttgaatgtttgctcaggtggggagggagaagttgtttttgtcaattcttccattattgcttagtagtactaggagcagagcacagaggcagaacttggtatccaacctggctagcaggggaaagttttcagacttttgggacagagagtcctagcccgctgagagaactaaggacaatatatgaaggcagacgatgacatctagacatgttcagtcaatgaattttcccttcactcctttcttgtttactctgaattatcatatttttttcaaacatctttacttcctgaatgtttactcttctgttccctaattcctaccctccggtccagtccagggagtcctaagggagacctgggggtaaaagtcatctatcttttgtctagaacacctgcatcgttcatccattcagtcttcattcagcaaactcttccacatgcctttccattgccagttctgttcccacacctttctgtgctctggagacctggaaagaaccctgcctatggatgtgttttccaggtactcccagcctagtaggaacagtcccccacaagacattcccagtccacataggcaaggatggagttgagagcaagagaagcatggctgggagtacagaaagtgtgatagaaagtgtttcaagccagatctggtggctgtcgcttgtgataccaagtaccgaggaggctgaagtgggataatcacttgaggtcaggtttaagatcaacctgggcaatatagaaagaacccatttctaaaaaagtaaaaaaccaaaataataaagtgcctcaactgaaaccctgaatggtgatcagtaggtgtttggatgcagtagtgccctaggtcaaaaagaaagtctgggcaaaaatgcaaaaagagggagcaggagagagggagaagagggaaagagaggtttgtgtgtcagggaaggagatggttataaagggagggagaagtaagagggaggaaaagtgagggagagcaagataaagagaggagggaagacagaaggagacagagagagaatgagagagaaaggaactgagttgtgatgagataataactatggtagtgaaagcagagtctggctgtggaaaatatgggaaaatggtaatggcttccattttaacccaaaggcaatgggaagccataacaagtggttgagcaggggaggggcaggtcatatctgggcaccagaaagatcttttcagagctactgtggagagaggaccagctgtagaatgaagtcccagtgaagacattctgggacctgagccagggcaggggctggggatggagaggaggcaatggactggacatgtgttttggaggccgtgtcctcccgtccaagcctttgctcagcacagcagtcctaaaaggtggcaacactttttatgcttttaaaaaccaagatatcaagtaatactgtgcactttgtaaacaaaaaaaagtgtctaaaacatttataaaaatgagctttcctcatgcctgtaatcccagcactttggaaggccgaggcgggcggatcacgaggtcaggagatcgagaccatcctggctaacacggtgaaaccccgtctctactaaaagtataaaaaattagccgggcgtgatggcaggtgcctgtagtcccagctactctggaggctgaggcaggagaatggcgtgaacccgggtggcggagcttgcagtgagctgagatggcaccattgcactccagcctgggcaacagagtgagactctttctcaaaaaaaaaaaaaaaagagcttccttcttaactgtcaccctagtagtttctaccatcaatggttttgtgtgtccctccagaagatggctatcttgatgcccactttataagaacacagacttcttctatacaaataagagtgtataaaatagacacagtactttttcccaagatggtgggttggaggcaatgtcagtgtgcctctcccatgtggaaggacagaatagtgtgtagagattcacagtgtaagctttcttttcccaagaaacaacacagggacttaacaggaaaaccagaagaatccacaaacccttcaaaagaagctacaggctgcattctactctgtgagacaggtgaaaaactgtgaatcctcagagtaagagggggagagactgcttcctaggtacacatcttcactggggaatctgaaaatccagaccacaggagaaggccttaactctatccagggcttgaactgatttagggagtggtaagaaatataaaagtagaagcagcagcaggaagtcccttgcaggcattcacaatctccagcatggactgagggaagccattccttattgtatctcacaggggaccttggggaagtcagacaactagctcaggtgaggtcacaggttgaacgaaatgcccaaatgaatttcttgatataacctcgagtggggatgaactcccttgaccagaacccgggaggcaagcaggaagtgtgctgcagacaggagttcagaagctgggtgcctggccttggacagggacaaaaaaggacatggcctgaaagcattgctatttctgtgggaaaagcttatggcctggggcagggctgagttctgtgcacagactgcctggatctaaatccagtgctatgagtggaacactgcatgtgtgagacccaccttgtgccaactgcatgggagctagatgaggcttactgccacctgctactctccactcccttgtcaaactcttctgtgaggcagaggcagttatactcacctctggatcattaccccagtgacctaagaaccaccctctgactctcacagggcaaaacaaacaaacaaaaaaacagttgcaaaaaaaaaaaaatacctaggaatatacttaaccaaggaggttaaagctctctacaaggagaactacaaaacagtgctggacaaaaccatagatgacacaaaccaatgaaaacacatcccatgttcatggattggaagaatcaatattgtgaaaatgatcatagtgcaaagcaatctacagatttaacgcaatgcctatgaaaataccttcatcatttttcacacaactgggaaaagcaattctaaaattcatatggaaccaaaacagagcctgtgtagtcaaagcaataccaagcaaaaagaaaaaatttggaggcatcacattaccggacttcaaattacattacaaggctacaattaccaaaacagcatggtactggtataaaagtaggcatttagatgaatggaacagaaaggaggacccagaaataaagccaaatacttacagccaactgatctttgacaaagcatacaaaaacataaattggggaaagacaccctattcaataaatggtgctgggaaaactggacagtcacatgtagaaaaatgaaactgcatccccatctctcaccttgtacaaaaatcaaaggcttaaatctaagacagaaaccataacaattttataagataaccttggaaaaactcttttggacattggcctaggcaaagaattcgtgaccaagaccacaaaagcaaatgcaacaaaaccaaaaataaatcagtggaacttaattaaactaaaaagcttctgcacaacaaaataataataataataatagccgacttaacagacaacctacagagtgggggaaaatatttgcaaactatgcatctgacaaagggctagtatccagaatctacaaggaactcaaacaactcagcaaggaaaaaaaacaaacaaacaattagttccatcaaaaagtgggcaaagggcatgaacagataattctcaaaagaagatacacaaacagccacgaaacatatgaaaaaatgctcaacatcactaatcatcagggatatgcaaattaaaaccacaatgagataccatcttgtttctacaagaatggccataattaaaaagtcaaaaaacaatagatgtatgttgtggatgtattgaaaagtgaatgctcatacactgctatgaaaattaacataacctctgtggaaaacgataaggatattccttagcgaactaaaagtaaatctaccattccatccagcaatctcactactaggtatccacccaaaggaaaagtgattatatgaaaaagacacatgcacatgcatgcttatagtagcacaattcacaattgtaaaggtacggaaccaacctaactgcccattgaccaatgagtggataaagaaaatgtggcatatatacacaatggaatactactcagtcataaaaaggaatgaaataatgtcttttgccgcaacttggatggagctggaggccattattctaagtgaagtaactcaagaatagaaaaccaaataccatatattttcacctataagtgggagctaagctgtgaggacacaaatacatacagagtgatataatgagctttggagactcggagagcaaggttgggagccgggtaagggagaaaagactgcatattggggacagtatacactgcatgggtgatgggtgcactaaaacctcagaattcaccactatagaaatcatccatgtaaccaaaccacttatatcccaaatgctattgaaataaaaggaagtaaagaagagacagatctgcacattaacaatatatctttgggagcttttctttttctaaaaatatgagttttggaaaattagttcgtttttatttttaattggcaaattttaattatatatgtttatggggtgcaatgtgatattatgatatatgtatacaacgtggaatgattaagtcaatttaataaacatacccgtcatctcatatactcatcatttttgtggtgagaatatttgaaatttgctctcttagcaattttgagaaatttattattattaactgtagtcaccatgcatgcaatagatctcaaaacttattccttctaacggaaacttgtaccctttgaccaatgtctttccattctttcttcctcccttctctggtaaccaccattctcttcttggtttctatgatttctgtgttaattatttcagatctcacagttaattaaggttatgtgctgtttgtctctttgtgcctggctcatttcacttagcataatgtcctttaggttcttgcagattgccacaaatgaaagaattttcttctgttttaaggctgactagcattccattttgtatatatacaccacacggaaaatgagttttgaattacaaaagcaatgatgagaacagtttcttcttgcactcaatgaggcatcacagatagacaagggttattcttgacattcctgctatcccacctaatatcctccctttctccaagggggcctgtagagatacttatttgtcatctatctgtctgtctgtttacatctatctacatatctttctatcatcgatctcttcttatattccttatattttttgtcctatggtatttacatatatggacatttgggaacatgtttttttccactcaatactgtgtctgacagatattttttctgagtgctgaatagcattccatgttttatttggcccatccctttgttgaagacacttgcgtaaacatttccaatcattggaggtatggccaatttgcattccagagtctctgtactgatttagcttctggtctgcattgtgtgacaggactagtgatcctttttttctccttttgtgtagctgtatactattccattgtgtggatgtttatctaaacatctccccatccatgtatatttggcttgtttcatccttttgctaaattaaacttgtgcaatcggcatgtgtgtacagtgagcattgctcatatgtataaacatcactgcaggacaaattcccaaaagtgcaattgttgaaccaaagaccatttgcattctacagttgtaataatgattgcaaatccatctctatattaggtgagtttgatggcactagctttcccacaaatttgccaatagtattattgtattattaaatttaaattttttgtccatcttcatatttcatcttttaatgagcattttcttaaataagagtgagaaagaacatcctttgcccaagttgataagccatttattttctttctatgggagtggtcatctgatattttctgctgtttttctttgggttcttttttcttatttacttataagaatgtgtatcacaattaatgttttttttttctgtttttttgttgcaaaagattgccttttgacttttttggggggtgcttttggttaatttttatgaagttacatttgttcgtattttcttttgtaccacactacccagctatttcccagagttttgtggggcttcctttggcagatgggaagtttccacttattcacatgcccgtctctgacctttttagtcttttgaatgcatccgtttttatggcattgccagactattttttcttactgtgacttttcttttcttttttctttttttgagatggagtctagctttgtcgcccaggctggagtgcagtggtgcgatctcagcttactgaaacctcctgcctctctggttcaagctattctcctgcctcagcctcccgagtaactgggactacaggcaccctccaccacgcctggctaattcttgttttaggtagagatgaggtttcaccacattggtcaggctggtctcaaactcttgacctcaagtgatccacccacctcggcctcccaatactctgactttctaatgggttttaatatctggcagagtggctttttttgttgttaaatcaacccctgcaaacatttattgtgtgataaagtgtatgttttatttggattgagggaaatttataatgaaatacagagatttcatgtttctttttaagtttaatccaggtattttatattattatgactagtatcttttcttttattatcttttcatttgatggttatttctatatggtaaaactaatgatttatgcatataaattctatgcccagtgaacatagtatatgctaaagatggtatctgtatcaagagaaaaaatatagataattaagtaaaagctcttggggcaactggaaagccttctggaaaaaaggcaactgaaccttgttctcatatcttatgacaagataatgttcagattaatcatttttttctaaaagagtcctaaaagctctagaaggaaccatgagaaaattatttcatagcgccagagtagggataaccttattttgacgtaagtcccaggggctatgaaaaagtgataaactgttaaatgagagaaaagatacacgccagccacggtggttcatgactgtaatcccagtactttgtgaggccaaggtgggcagatcacttgagatcaggagttcaagaccagccttgccaaattggggaaactccatctctactaaaaataaaaaaaaaaattagctggctgttgtggtgaatgcctgtagtcccagctacttgggaggctgaggcagtagaatcacttgaaccagggaggtggaggttgcagtgagacaagattgtgtcactgcactccagcctgagcaacagagactccattccctccccccatcaaaaaagatacagaatagtgtctacagtagatggtgtgctcctatataattttttaagatgcttaaaatcagcccagaaagcatacattaaaaaaaataataacctggcaacgtgtggggagaagtaaatggcattgggccataggagtgaattatgttttatagttttcaaattctgaaccagataattgtagacggtatgaaaattttaaatagccactgcaaaagaagaaagattaagcagagaattcagctcctttgcttgatcttaaatgtttataaacgttttccagtggggcctctagtgttttctaagtataaaatcactatctgccaaaatgatacatttactaccacatttcaaattgcctgactctcgtgtttttttggctgcataaatgtcttcttttgagaagtgtctgttcatgtccttcgcccactttttgatggagttgtttttttcttgtaaatttgtttgacttcattgtagattctggatattagccctctgtcagatgagtaggttgcgaaaattttctcccattttgtacgttgcctgttcactctgatggtagtttcttttgctgtgcagaagctctttagtttaattagatcccatttgtcaattttggcttttgttgccattgcttttggtgttttagacatgaagtccttgcccatgtctatgtcttgaatggtaatgcctcggttttcttctagggtttttatggttttaggtctaacgtttaagtctttattccatcttgaattaatttttgtataaggtgtaaggaagggatctagtttcagctttctacatatggctagccagttttcccagcaccatttattaaacagggaatcctttccccattgcttgtttttctcaggtttgtcaaagatcagatagttgtagacatgtggcattaactctgagggctctgttctgttccattgatctagatctctgttttggtaccagtaccatgctgttttggttactgtagccttgtagtatagtttgaagtcaagtagcatgatgcctccagctttgttcttttggcttaggattgacttggcgatgcgggctcctttttggtgccatatgaactttaaagtagttttttccaattctgtgaagaaagtcattggtagcttgatggggatggcattgaatctataaattatcttgggcagtatggccattttcatgatattgattcttcctacccatgagcatggaatgttcttccctttctttgcaccctcttttatttcattgagcagtggtttgtagttctccttgaagaggtccttcacgtcccttgtaagttggattcctaggtattttcttctctttgaagcagttgtgaatgggagttcactcatgatttggctctctgtttgtctgttattggtgtataagaatgcttgtgatttttgtccattgattttgtatcctgagactttgctgaagttgcttatcagcttaaggagattttgggctgagacaatggggttttctagatatacaatcatgtcatctgcaaacagggacaatttgacgtcttcttttcctaattgaataacctttatttccttctcctgcctaattgccctggccagaacttccaacactttatgcagccaaaaaacacatgaaaaaatgctcaccatcactggccatcaaagaaatgcaaatcaaaaccacaatgagataccatctcacaccagttagaatggcaatcattaaaaagtcaggaaacaacaggtgctggacaggatgtggagaaataggaacacttttacactgttggtgggactgtaaactagttcaaccatggtggaagtcagtgtggcgattcctcagggatctagaactagaaataccatttgacccagccatcccattactgggtatatacccaaaggactataaatcatgcggctataaagacacatgcacatgtatgtttattgcggcactattcacaacagcaaagacttggaaccaacccaaatgtccaacaatgatagactggattaagaaaatgtggcacatatacaccatggaatactatgcagccataaaaaatgatgagttcatgtcccttgtagggacatggatgaaattggaaatcatcattctcagtaaactatcgcaaagacaaaaaaaccaaacaccgcatgttctcactcataggtgggaattgaacaatgagaacacatggacacaggaaggggaacatcacactctggggactgttgtggggtggggggagggggaagggatagcattaggagatataactaatgctaaatgatgagttaatgggtgcagcacaccagcatggcacatgtatacatatgtaactaacctgcacattgtgcacatgtaccctaaaagtataataataataaaaaaaaaaaaacaaattgcatgactctccttttttcccttgcctaattgcacttgctggtatctctagcatcacgctaaataagagcaaaacattggatctgggtattttgtttgttattcatttgcatttgagtttgctttcttgccatagacaatatttatttttatgtgagtttgttaattttttaccgctggcttctgggtgttttcctcagagtatttatttttatctatttggctaaattttctctggtacttttctaattctctgcttctctaattgttttctgctttttaaaattctcaaatgtttgatccccgtggagtttattttgtgatagggagaaaaggtctcatttgcaaatagaaaaggtggagagttgtgtatttgttcccttgataatgactggggctggggtgtttccttagggacgacctggcccagctgcccttcctgaccatgtgcgtgaaggagagcctgaggttacatcccccagctcccttcatctcccgatgctgcacccaggacattgttctcccagatggccgagtcatccccaaaggtgcccacagcctcagggggagaagcctcccgggtaggaagatggttccctcaggggatccttgtcctgactgcccctttctctcccacaggcattacctgcctcatcgatattataggggtccatcacaacccaactgtgtggccggatcctgaggtgctgccttccccattcaccaccaccacccccatcctctacttttgtgtgtgtgtgtgtgaattccaaggttcctagtggagggggcagggttttgatgaggaaaatccaacatcacctcaccccaaaacacacacaagtgtctctccaaggctgctggacataggaaatcccactggcaaaccttctttgtctcacctgcaggtctacgaccccttccgctttgacccagagaacagcaaggggaggtcacctctggcttttattcctttctccgcagggcccaggtaagagcgccctgtgtctgaggcagggatgggatgatgggtgcgggagttaaaaaaagggggacgttgcagatggtcccagttccagctctccttccctccattccttcacagtttatgggaaaacgtccatagaatggggatgagtaggtcctagaggggtccgcggagtgctcaaaatccccttctccatctgctggtctgagctgggagctggagtcaggcccagtctccgggacatacaagcccacatgggagtcccaggcacgcttagtctttctctctctctctcaggctgagctgggtgcagttgggggtcccaggccaggttcctgggttgatgggacccaaatgcgggtcttgggcacagtcacagtccccactcccgcctgcaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaagcttgcagtgactttctgacccatccacctgtttttttgcagattgtcatgaataaaacggtgctgtcacctctgcctgggcctcactgacagcctgcag

SEQ ID NO: 780 - DNA, 207075 bp, Homo sapiens
gctttccggggccggcagaggaggatctaggtagagtacagacgtcagccccgctctggcggggcccggacagaaccgggcatgctccgggcacctcccatcatgcggaccgtcccacaaacacacgttagcatgtttagaaagggagctaagaagaactaagtacaatgcggcacttttttccaaaaataatagtttttaagcattacggaagtgctaggtgaggaagggctgctcctggccctcaggaactgaggcagccgttcacataaacgatgcatgtctccagaggtgaaggacccctccttcccttgctcctctgtgtctaaacatattctaagcaaactcaggaagcagggtgttcccgcatttgcatttttcatgtagaccttccttggcaggaagcagctcatctctccagctggccccacacactggggtctggatgctgagtatgactgtgcgcttccttccaagggccctgcgagaggctgccacgacacactttccccgatgctggttcaaatcacgtggaaatttcatttctgagctgccaccagcacagcaaagctggtgccatatttgccatcagtcttttgacatggagctatgcttacaagaacaaggcccaatgcttctgttaaagatgtgaaatgttgaatacatctgacatcaaactgttgaataaaatcaacgtcaaaccacagctgaagacggaagccccatcagtggctctgtctgtggttattctctaacctaaaagaggtttgttgctgtctgtggttattctctaacctaaaagattgtcagcctctttctcaagccactgacagctgtctgcagtgacagcactcagggctgggtctcggatcataagttcaatttatatttaaatgtacatttttaaaaacgtatttcagacttttagccagtgcatctattgctggtttgatttgcctaaagaataatatcgaaaattgaaggagtccactttgtataaagctgtgatttttgttaaagaaaactacagccaaaaagtgtttgcttttcaatataagatgatggaaatgggtagagttctaaaggatgaccgtccattatccactgcaactgagtcctagatttgttgctaactgacgttctacacagcctttcttcactcggaaatagacgagtgaaagtatttcgacttctcattaggaaggaacagtggctatcatgtttgaataattatgcatctgtttttttaaacctcagtctggcaatactccatcgcgatgaatcttcactactcagcctgcctggggaggcttccaaatgcacgggactcatttgacgtttgttttcttgaggctttggaggtagctcagctgcctttgcactgtctctggacaatgttaatgtcatagttgtgtctattccagttcttctccatagcagcggcgcccacgtgccccaggggccttctctggggcagcaggaggtacctggggtggttctgcttgggctcaggcacagtgaaaagaacctggaggctggagcagggggcacagaactgaaacaagagtgcaggagtcactctggggaggccagctttgcctggattctgaccctggactccgtggttgagagtttgtttgttctgcagccacacaagtgagcatcgagggatgaggctggggggcgaaggaggcagaatgtcacatgggtggcttggtgaaggctggattgtagggacagaaagcattttttcatcttagccctttgtaagtaagttcaacagcattaaatgcattcatgttgctgtatagccgtcagcacctctgtctctagaactttttcctcttctgcaagtaaaactctgtccccatgaaacactcagtccctttcccctccccagccctggaacccccattctgctttctgtctctgaaactgactcctccagggccctcctagaagtggaaccacacaggatttgttgttttgtgactgctcatttcacatggggtaatgtcttcttgttactgcatgtatcaatgtgtcacacgccctttctgttgaaggctgagccacactgcactttgtggatggaccacactggtttccattcctccgtggacagaccccgggtcgcttctccttggccagtgtgaatggtactgctgtgaacacggagtgcagctctctctccacgtcactgttttcggttcatttgggtaaatgtccagaagtggaattggtggatcccatggtgaagcgatgcttcctcgttttgaggaacctccacactgcttagggacagggtgtgctttgcgagctgcctctacagtcttgccatggggtgggggttggccattgtaagaatgagaagggtcagatgttagaagctctggaaagaaggaaatgagagaatttggtgacggttggctgagaggaccctcaaacacgtgcctggctttcccctcttggggtggtacgtgggtggaggactctggagggagagggaggaactgctgtagccatctggtgagcccagggacctgaagcagccaggtgcaggcacacggtgacctggagtcacaagatttgtgcagaagtgcacctcgtgaggaaggtggacgcattggttccagggaggccttttagcccattcgtgcaaatattaggtcttgaccctggttctatgtcagtcaggatcacttggggaaagtttaaaaacataccagtgcccaggccccacctgatgtatttgtctgagaaaggacttggccattgtcgtctttaaaagttctttacctgatgcttttttttttaatggaagaaacgcttcttgttttactttaaaaatattttttctagctttattaagttatattcacggatataaattgtgtgtatagtatacaacgtgatgttttgatacaggtatacgttgtgagataagtcaacaaagctagttaacatcttgccacctcacatccttatcatcaccttgtgcttttaagaacatttaagatctcatctcttagcagttttcaagtaaacaaaccatttaactgtggccaccacgtggtaccatagacctcgtcacttactcctcttgtctaactgaaatgctgcacccttccgccaacatcctcccagttccccccaaccctctctctgttgaccactgttctaccctctgcttctgagttctatgctttcagattccacgtgtaagtgaggtcacgcggcacctgtctttctgtgcctggcttgttccacttagcatgatgtcctccaggctcatctatgttgttgcaaatgctaggatttctcactttttaagactgagtaggtattccacattttctttgtctgtgcctctgctgatgggcttgaggttggttctgcgtgttggctgtggtgaacagcatcttaacgaacacgagagagcagataccccttccacacatccattttattcccttcagaaaaatacccagaagtgggattcctggattattcctttatcattctaatgtacccctaggattgagaatcctgatataaaacatatgaaaggataattaagagaaaaagcaaaaaacacaaaaagaaaggaaggaagaaggaaggaaagagggagggaaggatatctgagttatgttcccaacactatcataacaacattgggagcaaatagcattattttagacatttgtttttccaaattgagtgttccaatctcctcatctttaaattgagagggttaaatgatgatttttaagggatcttcccagtcacgaatttatggatctataattctactgggtcaaattaaaattaaaaacacttcataatgatcttgatgctattatagtgaatgagtaactatcatttccaaaatgctgtgggacattttacagcacagtataggttaaagtcataaagcaatgaagtgacatttgcttctggtcctatttcaaagcatcaatcttttttttccaactcccctcagtcttcaaaagctccaaggaaagctgagtagcattggctgaagagcttaagataccattagtgccagatgaattaataaaaccgcccacacttgtgttattagccattacctcttaagagcatttgcgttctctgaagctcatagagtgtaatgtatgaaaagtaattttatgatggggaaaatggctgtgaaatataggaggataaggaagttttccataaaattaaagtcactgataaaatgaattaatgtagcacattcaaaacgaataccttgaaagagaaaaacctcactttttccagaagaaatgtttctagggaagaccttcagacacactagaattaaattgctctcttaataacttttgtaacattggctcattatgacgttacttctaagaatggcattttttcattttcccgaatgttatatttaaatcagctgtaaagagttggtgatttatttgcatctatgaagagtgctatattgacccaaattttgcattgataaatgaatgcaaaatgaaattttaaaaagttggcagattaaattatcaaagtatattaagcacatattatatatgcagcacaacactgagaaaatgtacacactgtgtaattttgaaatacctgaatattaaaataatacttagagccttccacctggcaggcacatagattgtgaacatgtttttatataatagaacatcagctagcatagctttaatcatctccacagcatttaagtgcaccaatgtctcattctaatgttaatacatatcttgtctcacaggaattccccttgggatgtttatttttgtgtgttctttcaaaaaacaaaaacccagctctacctatacttgtcattttatcgtccatacttattttcttcagggaaatttatagaaatagcggaagtgtattacattgtaggttcttggtctcactgacgtcaagaatgaagctgtggaccttttgggtgagtgtccggagtttgttccttttaatgttcagacgtttttggagtttcttccttctggtcggtttgtggtctcaatggcctcaggagtgaagctgcagatcttcgcggtgagtgttgcagctcataaaaggagtgcggacccaaagagtgagcaacagcaagatttagtgcatacagcgtaaaaattaagcatccacactgcccaagacgatctcagcaggttgccagtgccggctcaggcagactgcttttattcccttatctggccccacccacatcctgctgattggtccattttacagagagctgattggtctgttttacaaagagctgattggtctgttttgacagggtgctgattggtgcatttacaatccctgagctagacaaagagtgctgattggtgcatttacaatcctctatctagacataaaagttttccaagtccccactagatgagctagacacagagcatagattggtgcatttacaaaccttgagctagacacagagtgctgattggtgcatttacaatcctctagctagacataaaagttctccaagtccccaccagattagctagatacagggtgctgattggtgcatctacaaaccttttgctagacacagagttctcattggtgcatttacaatctcctagctacacataaaagttctccaagtccccaccggactcaggagcccagctggcttcacctagcggatcctgcgctggggccacgggcagagctgcctgccaggcgcctgcactcctcagcccttggagggtcaatgggaccgggcgccgcggagcagggggcagcgtccatcagggaggcttgggccgcgcgggagcccaccgcgagggggaggctcaggcatggcgggctgcaggtcccgagccctgtcccacggggaggcagctgaggcccggggagatttggcgtgcagcgccggtgggccagcactgctgggggacccagcacatcctccgcagctgctggcccaggtgctgagcccttcactgccccgctggcgctggccggccgctccaagtgcggggccgcggagcccgcgcccacccagaactcgcgctggcccatgagcccacacctctccctccacgcctccccgcaagcagagggagccggctccggcctcggccagcccccagggcagtggctggctgaagggctcctcaagtgcggccggagtgggcgccgaggcggaggaggcgccgggagtgagtgagggctgccagcatgctgtcacctctcagaagcagtgatgtgctgagcttctgtctagaaagaaggtagcagtccaccctcctgtctcccaggcattcgttcacccaggtcctcagccaccgagtcttcctccttcacccacgaccctccttcacccaccaccctccctccacccaccaccctccctcccaggcatcctgtagcctccaccaccacacttcctgggaggttcaggcttcagccttgaccttcctgcactgcccaatgggagcatcgtgaccacacattttaggagaaggctccttccccactgtgacatcaaacacgtggtcacatgaaaggcctagtctgtggcacaggaaaggggccctgaggtgcaggggagggtcattgtcagttaatcacatgaaagctcaccagggcacactgcattttaacaaccccgtttttaaattttatttccacacaaacacatcagatacctttaaagttagacacatctaacatttgtggaacttaggatgccagggcttttcatctgaatttctggggtgcatttacagcttttctcctaaacatcacgcgtcccattctggcctcctgaagggcggtgcctgctcccgggctgccccctgccataccccgcaaacccccgccaccccctgcaaacgcccaccaccccccacccctcaccaccccccgcaaacccccgcaaacccccgccaccccctgcaaacgcccaccaccccccacccccccacccctcaccaccccctgcaaacccccacccccccccgcaaacccccgccaccctctgcaaacccccgccaccccctgcaaacgcccaccaccccccacccctcaccaccccctgcaaacccccgccaccacgcgcacatcgctgttgatcattgctgcctccacgcgcgccgacatccattcaaacagcaattgctggtgttttctcctctgtgggatgtgccagtaagaatgacctggaagctcccagacatacgtagcaggctcaacgtggcgggggagttggaaggaaaaatggaatccacaactgctgcgcacaggagggaaatgaacccagtgcccgcaggaggcgctgacggcgttccctaaaaacaccgagcaggcaaatgagtgcggactaagcgcccggggaagacggggaagacggggccaggctcgggctccggggattcgtaggatctccagaggggatcatttgtagttaaggatctaatattgccacattctcaatggttttctgttctgcagttctttagagcactgagttttaaaccatgggctgcaactcattaatgacccgtgaattcaagttactggtcactgccagcaaatttttaaatggaaacaaaaatacaacagagaagtatagactaggccgggcacggtggctcacgcctgtaatctcagcactttgggaggccgaggcgggcggatcacgaggtcaggagatcgagaccatcctgcctaaagctgtaaaaccccgtctctactaaaatacaaaatattagccgggcatggtggcgggcgcctgtaatcccagctactcgagaggctgaggcggaagaattgcttgaaccccggaggcagagattgcagtgagctgatattacgcctctgtgctccggcctggcaacagagcaagactccgtccaaaaaaaaaaaaaaaaccgtatagactagaaaataccaaagtacactctggataataagagcacatgtctaatgaaacattttttgggtgtgtgcgtgtgggtgtgtgtgttaggttctgatgtaaaatatacgtcttattgtggaatataatccaaaaagtttgaaagcccttggcaggagcaataccttgcagccatcagggtggtgcagagaaaggaagtcgcttttgtgctgtctcggtgtttgaaacaggaagcagtgcgtgtcgtgggttctcagaggcaggttctgcaggcaaagcctccgcacatacactggaacttgagcaattcacccacctctcctgttcttctcattctttgtttgttaacaaaaagagaagggatcgtaaccttcctacctcgttggaattttaagataattaaatatggtaatataagaccttagagcaaggtgtggctcacagcaagtgttcaatgtcagtttttaccatgattagtatcattgtcatcattgctcatacgctgtgaccaggtaacccagcatcacctgtccaggtttaaaggtgcattcaggaggtttcaggagtgcagctctggaggacgcggccgcggagaggagtcggtgtaatactccagacagatgtccacgttaacttcatgtgtttcccgaacatgatttccatgacaactaatttatttgcatattgcagtaactgaaaacacagacttctgtaattttagattctgaagagttttttgtaaggatttgcccctttaactgcctgtaaattacaagcacgctcccgtgcaaatgggcattcgaaaaggagtcggaatttgtccctgggaggtatttgtgatttagatggaaaattaaatagaaacaggctggctttccctggacaacagcgataacttgctgatgtgtttggaggtcagcctgtggctgtgaagtgtggcttccaggctcataggaagtgaaggtccgctgtcgggaccttgccagcctcgttgccccagatgtcaggcttccagaggaactctgcagtgcgtgacgaacgtattgttgcatcctctgaagagctgagaaacgtcatcagtttgtgatgcctgggccactccgtgaaagtgctgtcaaggatgggaaggtccagttttgtggcaggtccaagggttgaacacgacgaaggagggacaaggaaaggaactgcctcccacctgtcactctgcgtgggctccctgcgttctggtgccttggtcaatatgcttaacgccacagcaaacatgaaggtcacaggacgcgcattctcattctgcaggtgaggaaactgaggcacagagagagtggtgacttctccaaggtcattagtgaatgagtggccagtctaggtctgaaccaagccaaaccctgtaggaccttttgagtatccacactgcttccccaaggaaactaaaatattatatgtccaagtccaggaggtccactcaacaaataaaaggcaaaccttgcatttgacacctgaaactgaggtcggtgttacataattaataaggaattgtgtttggagtaaacctagaaggaacttgcacataagataatttgctcaatcaatctggcacatctccctttgctaatgagttaggcttctccagataaatctgtgagaatgttccattttctcaaacagtatttgttctccccagggcatcagttagttcagcttgaaacctttcttataatacaagcatcgtcattttcaccacactgtggaaccgaaaataaatttccctagtgggtgaccatcctccatggatgtaagggctgtctagtgtaggacaatcaatagatgaccatcttccatggacgtaagtgctgtctagtgtaagacagtcaatagatgaccatcttccatggacgtaagggctgtctagtgtaggacaatcagtagatgaccatctaccatggacgtaagggctgtctagtgtaggacaatcagtagatgaccatcttccatggacgtaagggctgtctagtgtaggacaatcagtagatgaccatcttccatggtcgtaagggctgtctagtgtaggacaatcagtagatgaccatcttccatggacgtaagggctgtctagtgtaggacaatcaatagatgaccatcttccatgggcgtaagtgctgtctagtgtaagacagtcaatagatgaccatcttccatggacgtaagtgctgtctagtgtaagacagtcaatagatgaccatcttccatggacgtaaggtctgtctagtgtaggacaatcagtagatgaccatcttccatggacgtaagggctgtctagtgtaggacaatcaatagatgaccatcttccatggacgtaagtgctgtctagtgtaagacaatcaatagatgaccatcttccatggacgtaaggtctgtctagtgtaggacaatcagtagatgaccatcttccatagacgtaagggctgtctagtgtaagacaatcagtaggtcacatgagcaaaggtgaaccccaaaatctgtttaggaattggaaagagaaacattaggctccaagtcttatcagagcctgacaaaaagcgtgcgtgttttatgtgcactttctaccaccactcgggtttggtattggatgaatactagctgcagttagcagtaattacacatctgactaacaatcttcagaagtctccctgagaacggtgttcctcagccctgtgacgcatcagcccaggtaggcagggctgagggccgacggcctccctaacgcgtctggtccacagttcagtgggagaagccctgctgggaacagctgggttagagtgcactcacgttgcagaaagcctgttgctagcaaacagatgtccattgtagaagaatgtgtgctcctccccataaatttcaaagaaacaaatgtcccataaacttaaaaataacccatgaatgttattacacttaccttgacaacatgatcaaagttgtttatttcacacggtttcataagcagaaatcgccagctagtgatcacggttcagacaaatggtggaaatcgtcggcggcatagggacggggccagcgtgggtgtcagccgtgggtgtggcagttccgcactgacctcggtgcattcctgctctggagtctagcatgggaaaatcacagcccagaagaccctcgggttgcacgtgtgactgacgcactcccccgagagaggccaacacctcacagcagcctgccgcagcagcgaaatgcctgcactgaggctgtctgttaaaagcaaacaacatggcagttgttttagccaagcacgcttcttgctgagaattctaggaggttcagctgacagcaaatgcgtgagtaccccagctcgctgtgtccatggagtagagatctcagacttcgcagctttgacttatcaatctaaaggttaattagacaaactgggtgactactgccaacattttctaaagacaggtcacactctaggtttctaatttgtcttccgaatgaccctgatcctggaaagtgaggccccgggtcatggtcgcaccgccaccctgtgccatctgtgtgtgcacgttggtgtcccaggccacagcggagaaagatgggagaggccacaggccaggccctgggaggatcagtgggataagcatctgcctttcccagtgcagaggaggatggaagaggccacaggccagctccagggaggctcagtgggataagcatctgcctttcccagtgcagggcaagacgggagaggccacaggccagctccagggaggctcggtgggataagcgtctgcctttcccagtgcaagggaggacggaagaggccacaggccagctccagggaggctcagtgggataagcatctgcctttcccagtgcagggcaagacgagagaggccacaggccagctccagggaggctcggtgggataagcgtctgcctttcccagtgcaagggaggacgggagaggccacaggccagctccagggaggctcggtgggatacgctactgcctttcccagtgcagaggaggaagggagaggccacaggccagccccacggaggctcggtgggatacacgtccgcctttccctgggaacagctggtgggagcggtgcaagcacagcccagctcagaggggccgtcacccccatcagtggcaagtggtttgcctctgtggcatagcacctgcccatctcccagagacaatactgcctggaaaattgcagcattgaatttctaacctaaaaattgaggtgagaccttgctaagccctcctggtcgtgtatgtaagctcgttgggaactgcagcttttctcagtaaaagcttcctaatcatatgcaattccctaaaagtacactttttaataaacaattatagatgtgtaagttacaaaaataatacagagaaatcctgggcacccttcccccagtttcacccatggtcacgttcgtacagtccaaggtccaacacgaaacatccttcttccagacaatggcggtcgaacctcagacccatccttgccttccttccctccttcattcatccatccatttcagcatttactgaaaccctgctgcctacgcaatgtgattgagatgttgaactgaaaggtaccaggagctcacacatcccctccccttcccgggttatcttacgtgatatggggcacagatttgctttaaataatttacttctgagcgcccaccactctggagaagagctaggcaggcattgggtggcgtcttgtggccacacgagcagccccaggtgaagcaaagcctgcacccaattagacatctaggaattcacagtgacgggaaagaggaattgtacataattagagatatgttttctctccagtacaaatgtcctctttctgcctgaatttaaatgcaactctcattttttcttatgcgactattcccagaaggcttcccgcatcctgcgaagcgaagggtaacccccaacagcccaggtgttttcaatggcacacatggttcctgctttctgtttcacataacacagaaccccagagcacgttttaagctccacttttaaaacttaatgaaattgtataaaattcagctactgtatcaaggaacagcgagaaaatattgtgttggagaatataaaaggaaataatatgaatagcgttaatatttcagtaagagctacacatgtggtcaggagtgtgaaacttctatcagccatttatgggtgtttctcacctccaggcgccgctagagaactttgcttatactcacctatgtcactcatcccttcacagctgtgtggcctctctgctgtcaccccattctaaaggaggggacagcacgtgacagaacgagtcccacagtcagtgaggatgggcacacgctgcaggtggaggcccaagctcctagtccatgtagctgctgcatctctcagcaggacaggaaaggaaggccggcctgagtccggagggtggcgctcagcgtgatgccacccagagtctgacagagctgcatggcaggaccccggggagatgaaagccagccccacgaggggaagagcccctacaagagcacagccagcgggcaggagcacgcagggagaccgacgtgcagggacaccaacgtgtagagagactgacgtggagggagaccgacatggagggagaccgacgtgcagggagaccaacgtgcagggataccgatccctgcagggagaccaacatgcagaaaacgcatgtttggcctgaaatgggatggatgcatccaaccaaagagaaaacaaggaaggaggagacatggaaggcagccttggaaatcacggagagttgttgcattgattcttttgcagccgatgagcacacccaccctgcacttgagtttcagggccaaggtgtctttctttcttttgaagggaaaaaggacctgggccagagaaaccatcatggaggcatcctgggaggggcacagagaaaaggagtcctctcccttcccttaagacagacagggcagtcagcatacacatgcacatacatgaacacacaggcatgcacacagatgtgcacacacacacgcagacacatgcacacacacgtgcagacatgaaaacaattgtagacatgcaaaaatatgcagacagaaatgtgcacacacacacacaggtgcatgcacatgcagacacacatgcagatgcacacaaacacgagcagacatgaaaatacaattgcagacatgcaaaaatatgcagacacacgtgcatgcacacacacatgcagacacaagcacacacacatgcagacatgaaatatacacatacacatgttgacacacacaacatgcacaaatatgcagacacacaaacacatgcacagataggcacactcacacacttgtatgcacacacatgcacaaacatacaacacatacaacacacctgacctgtctgcccctccagtctgttccctgctcccattccctctgtactgtgctatggactctttaattcctttcccttttcctccacatctcacagagggatgggcttattacaatgtgcagttcccttaatggatgagtgagtgaatgagtgcaggagggaatgatcgagtgagtgaatgactggatgagtgactgagttactgagtgagaatgagtgagtgagtgcatgaatgagtgagtgaatgagtaactgagtgaatgagtgagtgggtgagtaaaaaagtacatgaatgagtgcatgaatgagtgactgagtgaatgagtgactgagtgaggaaaggaaagagggagggaatgagtgagtgagtgattggatgagtgaccaagtgagttactgagtgagaatgagtgaatgtgtgcatgaatgagtgagtgaatgagtgagttactgagtaaatgagtgagtgaaagagcacacaaatgagtgactgaatgagtgcatgaatgagtgagtgaatgagggagggagggagtgaatgagttcatgaatgagtgagtgaataagggagggagtgaatgagtgagtgagtgactgagtgaatgagtgggtgactgagtgaaagagtgagtgactgaatgagtgggtgactgagggaaagagtgactgagtgaatgagtgggtgactgagtgaaagagtacatgaatgagtgagtgaatgagttcatgaatcagtcagtgagtgagtgagtgcatgaatgagtgagtgaatgagggagggagggcgtgaatgagtgagtgaatgagtgcatgaatgagtgagtgaatcagggagggaaggagtgaatgagtgagtgagtgactgagtgaatgagtgggtgactgagtgaaagagtgagtgactgagtgaatgagtgggtgactgagtgaaagagtgagtgactgagaaaatgagtgggtgactgagtgaaagagtacacgaatgagtgagtgaatcagtgagtgagtgagtgcatgaatgagtgaaaggcacaatcaggcttgtgcctttttttgtgctgaaattagttttaagcaggtgaaactccctacagcttcaagaggatgaggagatatgttttgttctgtttgcttgaaacaataaaatacataaaaaatgaagcacctcatccactgtctcaggcagcgagagcctgccagtccccaacagccccagggtgcagaggtgaggaaggctttctcacctccgcggtcaccaggaatcgaggttcagtagaatcaccccatcttgaaggccgcagcctcaaggtccaagtcttcattccccaggttgaagacatgagctggggacccccatggctgtgggtggagggcgagtcctggacgtagtgcttcattctgtcttttgaaaggggtgatgttagaaagtgagttctggcagctgtggggaggaagaagtcaagccctctgtggggtcaggagcttggaaaaaggaccctgaagagttagacctggagtggccagacctaggcagggatggaagaacggatgtggagcccaggaggagcagagagcacgccatgagggaggggccgtggtgaggggcacccctgggcgcccagtgcttggtcctgcaacaccttacgtctcagggcgtttccccaccccctgctccactgagagcctcccaccctggcctcgtttcctccaccgagctgtgcatcctcagggagagagagcagaagagccgctcctctttggaaaactgagaagctctcctccgagtcagtgctctccccatccaccagcaaggggcccctccatccgaatgcaggcacacacctgctaaaatgcaccacacagcagaagggcctcccgtttctggctaggagagccctgcctgtggcaggcagcagcatttgcaagcctctctgcagttacgcttggagttttggtgtggtggaaataggcaagaagtcgatgtccagctgcttgttggattagggatcacaaatgtgtgtttattttccaaaaacaagacattggcatgatagtgtggccctgggggcagggtcatggaataagacagagactggggagccttgcacaaaataaccatcccccacggtatgttgtttggacctgggaactttctggagcaagtgctcatcgtcagtaacacacactaactgaatttcactcaaggcagatttgtggactattttgttgaaatgacatctgtagaaaaatttaaaagtgattaaaactgatggctgctgccggatgatggagtctggtgcatctcagacagcccttatttggaacagtctgtgggcatgtctaggttattgagtgttacgcttctgtgttatgtgacttgtccgtaccatttagcctcccaattggacacggaatcgagtttgctagcgttcagccctaactggaatggcgactgctcccaaattgcattctggccctaatgaaatctgtctgcttcatcctcatctgccaggacacagcacattagctcttatgggttttgttgtttgtttttgtcttcagattgtcggttctgtggctgtggcaaaccgagtggaggtttaagatggacttttaaatacaaattatgaagggaaaaagcaagtcacttcatgtatgcttgtgcatttacaaggcacatagaacaaagctgacatttatataacgtttgagtttcataagagcatggctgtggtgactgtccagtttttagatgaagaaattgagtctcatccaaccttgatcagctaataaatgaccacgtggtgatttcggcccagacacccttatgttcctagtagacttgagctcaagtcatataaatttggttctccctgccatggacaatggttcttgagtaaattatggagtctttgagatttgtttttctcaggctccaaatattgtgataatatataaattgtacagtgattctgcaaaccatatcgaacccatgttagatatttgcattctagtcactgtctttggctactggaaatgattgtatgtgtgtgcacatcagcattcagtggatactgagcggcatctggatatttagtaaaacacattctcacgccagtgcccgtgcttctccctctgcgtggctaagatgagaccaactctgcttggagggtcctgtccatcccaggccctcccgaccgtgtgtcctccagctaattccgaaattttgagtgccaggatctcaacaacgagccacagataggagcctgtggtccctgccgtgaaggagctggcagtccaggaagggatacgaaggcttggctttcacatgtgatgtgctaaggtgtcagaagggaagaatatttcagctgcaattgggaagaaacagaaggggcttctggaaaatgagcaacgctgtcctggaaagtgaagaacaccaaagttagctcagctttacgcagcggcatgtcccatcctacgcctgaaaaccaaaaagcatagaacccttgtctacttggaaatcttaaaaaaaaaatctaaacatgtgctttgtgtgccaaacagtagctccaggttcactgactgcccgaaattcagtgttttgcacgacaagttcattaacctgctgctgaaagggcctttgcaattcaaggttggatccatcagaaaatagaatatgaaactgataaagctctcttttcaagtcaatactttatttcctctccaggaagagactttcgttagagaggcacaagctgcattctctgaccctgatccccttgtttaacggttctgacgaccctgagcctggctctccccatgcaccttccccatggacaccacctcttgcctaaactagattaaatgttccagaccccagaagaaaagtccagaactcattgtgggcctgggatccgtatgcacttgcctgcctgtaagaagccagcctgcgggcctggcccagctgggatgtcagcatcctggggacctggccctgtgctgcctgtcacagtgggttttgtgctcagcaggtgatggccccggcagggccgcccatggcttcctttgggggcacagagcaggggagcatgggtggggtggggatcctagaccaaaggggcgtggctgggtttgggtctatcctcccacacctgccctgggagcctcggtttccagtctgcaggaggaggaggagctcccagctgcttcgcaggagcaggaggtgtgggccatcgctgttggctgcatgtgaaggaggggccttctccactgagagctctctctgcccctggagtgctgggcacgctgtccccatctctgcttcccaacataccatgggctatacacctgatgaacatgttagtgattatctgacgagatcaatggttcatcagctatcgatggggtgtccacaatggctgaggagaagaacagctgcaggcccccaccccggagctcatggttcacagagggaagaagatgggaaaacgctggggcacacggaggggagcgatgcaatcggggaacccagaaagtatttggggagcaggaggaggttcactccgagtggtttcccgtgttcttcacccctcgcactggcgtggtgcatctgtcacaattgatgagccaggattgatgtgttagtgactaaagccatccttcatccttcacgtcaggggtcacgcttggcatggtccaccctgtgggtttggacgagtgtttaatggtgtggactccccactgccacctcacacagagcagtttccttgccctaaaaatcctgcgtgctccccctattcatccctccctgcccccaacccctggcaaacactgactctttcgctacctttgtagttctgccttttccagaatgacccatggattcaaagagtgtgaaggctttttcatggcttgggagctcatttcattttagcactgaataatattccactgcctgatgtaacggtttactcacctcctgaaggacatcttccaagtttgggcaattgtgaataatgttgctatacacatctgtgtgcgggttgatgtgtggatgtaagttttgagcttctttgggtgaatacctgggggcgtgattgctggactgcatggtgagtgcctagttttgtaagaaaccacgaaactgtcttccaaagtggctgcaccgctttgcactcccacgggtaatgaaagagttcctgaggctccgcgtcctggccggcgtgtggtactgttggggtctggattctggccgttctattcggggtgtggtggtgtcttgttgttgttttaatttggaatactcgggcgggaggtgatatggggcgtctggtttgcacacttgttttaatttggaatacttgggcggcaggtgatatggggcatctggtttgcacacttgttttaatttggaatactcgggggcaggtgatatggggcatctctggtttgcacacttgttttaatttggaatacttgggggcaggtgatatggggcatctctggtttgcacacttgttttaatttggaatactcgggcggcaggtgatatggggcatctggtttgcacacttgttttaatttggaatactcgggggcaggtgatatggagcgtctctggtttgcacacttgttttaatttggaatactcgggcggcaggtgatatggggcatctctggtttgcacacttgttttaatttggaatactcgggcggcaggtgatatggggcatctggtttgcacacttgttttaatttggaatactcgggggcagctgatatggggcgtctctggtttgcacacttgttttaatttggaatactcgggcggcaggtgatatggggcatctggtttgcacacttgttttaatttggaatactcgggcggcaggtgatatggggcatctggtttgcacacttgttttaatttggaatactcgggggcagctgatatggggcgtctctggtttgcacacttgttttaatttggaatactcgggcggcaggtgatatggggcatctggtttgcacacttgttttaatttggaatactcgggggcaggtgatttggggcgtctctggtttgcacacttgttttaatttggaatactcgggtggcaggtgatatggggcatctggtttgcacacttgttttaatttggaatactcggcagctgatatggggcgtctctggtttgcacacttgttttaatttggaatactcgggggcaggtgatttggggcgtctctggtttgcacacttgttttaatttggaatactcgggggcaggtgatttggggtgtctctggtttgcacacttgttttaatttggaatcctcgggtggcacgtggtgtggagcatctttggtttccacgcttggcatctgagtgtcctcttcggtggggtccactcagacctttcgcccatttttcccagttgggtttgatgcaccagcatcctgccgtataacagtctggttctgatgcttgttctgtttcttcaagctgtgtcttctgtgttgaaatatgccttgtggtagttttgctgaaagccgaaacagctgagtgcatggggaagctggcaggtgtgcagcagccggggcccagggcatcacacccacaggggcctgggggacctccttttgctcagagcacgggatccacagtgctggggccaaggccagtcagagcctcacgcacgggtgctgggtcatcaccatgcccgggaagctgggcccccggccatcagcagatcctttacttccttacgtcttggttttctcctcagtgaagcaggacgcacaggtttcctcatgtggccattgcaaggatttaaggggacgcctgtaaagtcaccagcagaacctgggagctgagtggaggagcttctttttcagcagaaagagggagaatgagttttcaggatcaggagacggcagtgacctgctgtgtaaactttcaaattacacgcgccaagtggttctaaataaatgaatcaggttaattagcaaacaacagccatttattctctttaatagcctcatgggatatcaagaggctattatatgatatgatatcatgcattttggcatgaaaattagggagtagctctacattgctaaagggatgcagctttttacctgggtgacagatgtatatgttttaaagtaacttaaatgcattaccctttgctcttcacgtcagccacataaactaaggaccaggggcagctggagactcactggtcagaaccagcagcactggggtcacacccaggctgggaacctgcagacggcactgcccgtgcggcatctcctgggacctgggagctttcacgccacgcgtatgataagttctggggggcgggagtgaggaaaaggcccccctctggtggtccgggcccatggtcctgccaggggcccacagcatgaagatgtagctccctcacacacacgttgaatttggatttgcttgtctggcttctgctggggcgcaggatgtggggatggaaggaccaagacacacgacagagaacagcgtcacggggtcaccgtcccacttcccaccccgcgcctcacagcacagacgggggatttgccggcctcacgccggccgagccactgctgacttcacgcagccccagccatgcccccacgcagacacacggagccccaaggcgggccagatctcagggccggatggggctgtggagctgtgccttagacgggggggaaggactccctgccccaggccggcaccgcacagtccctgggtagaaaattgagtcctgtttggaggacagctgctcccacatctgggggcctctggatctgcagggcagggctttggtggtccataaacataccccgaggaacactcgtggagccgtctgcattttatttttgtcaattatggcactaatcatgtccttttactagagatcccgcagtgtctgtgctccttcgttacatccctaaaagacaagctcccgagggccatccatggtggcctcccagcagttcctgcacgtcacagcatttaaaagaaatccagtgaataaaacagttcagcttcaattcagtaaccgcatagaatttcacttgtgaattgaaaagttcagggcctgagataatcttaagctgctggatctgtggggaaaacaaacatctgaggtccagaattcgtttggagactccgccgcaagtccggattcggcatcagatcagctgtgctgtgtgtgcttccaaagacgtttctgatctgcagggacgtcgtcccgtgtaagagttcagcggtgcctccactctggacggcagaactgatccccagacggggctggccttgtctttcaagcagagaccagagtgggcttttaaaggggaacatcttcagggtgtgcgtcggggtcagcctcatgttcccagagcccatctgagaggccggcagggaggaagggaccctgttccttgctgtctgttgtccaccaatctccttagaaggttgtctctttaggggacaacacagaccctcaccggtgctgactgggaggaaggagcctggctacccccagctgtgcttccaagcagtgtgagtcacatttagcgttgtttgcagaactgaaatgctccctgtagagtcagcttgggcagccctaactaaggagcccagactgggcggcttaaacaacggacgttgattctcccatgtcctggaggctgcagttcaagaccaaggtatggcagagctgaatcctgctgaggcccctctccctggcatgcaaaccccatcttctccttgtgtcctcacagcgtcatccctccgtgcgtttttgtgtccccatatcatcttctcaaaaaaatagatcctggagctctttccatataatcacataaaaaaccttctcattgcctttccaagggtacaagtgacgtcacacagtgagagggacacagtcatcggaccagcttacagtcttcccaccgccttgccacagacctgggctttctgtgaacatctcaggtccttccgtctgcatcactcttaccacccgtgggttcatcatcttcccacatgatcctgggaccttttagcgctgtgttctgctaaccctcctgcacacccttggccatttgtccccggttatttgttggtatttttcttcttgacttcttggtggttttgcggggagattgtccttttgtggatggcggagcagccaatcctttccctggctttcatttgcctttactttgcttccattgttttctttctgttcagaagtgctgagtgtgctcaaattccttggtcctttttgtacagcttctggattttcagctgttgttaggtctcctgaggcaacaacttcaaagcaattcaccggtgtgtctctaggactctgatgtcttttttttttttttttttttttgatatatgacattgttgaaacttttggggagcaaacttaccttaaagtcatgagttcaaaattcaaaccaggcttctgacaagttactaccactatgtattatctaatgtttagtttttggttaatggctttttattttagttggatttttctgaatgaaattgattgctgttagctggtggaattacaggagcattttccatccattttttctgagctgcgcagttattgatggtgaccatcagagtcccagtgtacaatcctggcgatggcagaacagggaggtgggcagaccccaaagctgcggtcctcagaaaatggaagaactcaggacttacacagcagaagctccacacttctaaagatttagtgaattcccagatccaaccatgtgcgaatcgcagaaagaatagtagatttaaaaagtcaccttgagattctaatgctgggaggttcttcctgatctcacctctgcttatacagtgtatcctcactcccagcctcttagcaaaatgccccaaatcacctgtgtggtgttgggcagtgatggagcctaggtgtatcttggcctcatctcttgtgtgacattgggtagtgacgggacctcagcatgtcttggcctcatctcctgtgtgacgttgggcggtgatgggaccttggtgtgtcttggctttgtctgtaaagtggatttatgctgcaggctaagtatccctcttctgaaatgcttggcattagacgtgtttcagatttggaatttttttggaatgggggacatttgcattacatacttgccaagtgaacatccctaatccaaaactctgaactccaaagcgctccagtgagcatttcctctgagcgtcaccgtggcagccagtaagtttcagatttgggagtaacaatgtaatgacaatgctgtgagcgcttctcagttcccatggtgttcccaacgggcttcagttcctgaacgctgttccctcctctgctggagcctcctgcattgactccccaggtggacgttgcggtggcgattgtgtttttacactcacgggtccatagccctgctctgtgacagcgcctcacctgcgttaaccttcctacctcttacctgcacgcctaccggcagggctgagagtctcccccactcacaggggaggaattgggggctcagagggtgggaatgcatgtgggtccaagggcagtcagtggtggagctggatttagactcattcaacttagactccggagcccaggaccataatcatgggcagtgctgcctctttattttggaagcagatgatgaaacacctgaattacaatcatttgaacaagcaaagctggtttgttctcatagcgagacttcccgaggaggacggtggtgagtcctggctgaccgctgagttctgccactgaagacaaaggctttcttcatcttttcactctgccatccttattgggttgactttaagtcctcttggttgcaaggaggttgccaggtatccagccactaactccacatcaagagaggaaggagggagctgcagtggtgtgagctacgtctatccctgttattggaaacccagagcttcccagagactcccctacgtgacttccatttacctctcaggcccagggttctctctgggcagccctcctgcagcagagcctggaaagggggcggtggctttgccaccttggagaggagagggcagggcaagagcaaaggaaacgtggtgtggcctcgagttaggctgcaagcagcgggtgccgtcacaagcccacccgttaccacgacttcgcatcgtctacattgcaggctcacgttcacatgccctatccaaccctctcctgcgagcagcgggtgccatcacaagcccacccgttaccacagcttcacatcgtctacaccgcgggctcacgttcacacgccctatccaaccctctcctgtgagttcacaaatccgtgactgacatggtgtgcacctcgtcctcttgtccaggcttctcacaaacaaaatgtcccaccccagctttcaagtctcaccagagcctttgctgccccatgcctgagtgacaccaccatccacccggctccagccagaggcccttgcccactgatcccctccgggaggggccacctggcacatctctgagtcaagtcaccgtcacaggcaagctcccgcttctcacgtgcaggacagatggcgccaggaagaggatgtcagtggaaagccataataagttcaaacatgaaattagtgtctcacacagcagctctggtctttgtcagactttaattgggatcagcacagattcattgccatggagagggaagtaaaatgggtaaattccagtgcatttctgagagtgagaaaagtttctatttttcctaaggaaagaagagaactgaaatacgcttccttttataacctatctatgtgggaacggaacggaaatattcagaatgtaaaacactcctgcctgtgtctatgcagcatgcacggcgtaactggggctggcacgaggggtcaaggacaagcaggactctacctgccacccccctcagggggacacagtgcacgcgtttagcatctcccaggacatgtgctacctgaagcccaagggaaagtccacccatttttaatattttctgtttgaaaaaaaaaatacacagctcatctttatgttcaactatgcttttaagtatctgcaaaaaaaaaaaagttcattcaactgattgtattacatacaattttcatggacattttttgtacagttatgacacttcagctaaaagaaaaaagtccttactgaaagaggcttaaaatacagaaagctttgcctctcctggaggaaccatcaataacgtggcttccagccactgcacggcagtgactgctgtgcggtccaggcctccaccccgtcggacgcagcgatacctttgaaaacagcacctcctcctgggttactgggttccactgctggaacagctgccccgaggctttctagctttcctcctcaggccactggccaggtctaggcccaagcaggagcccaccccaggcaggaggacaagtatcccaggaggacctgagcccacgaacactcctggctcactgcccaggcctggagtgaacagggcattgttcccaccccagtgccagggatgagggcagaggaagaaagtaaagcaaaacagaagacgtcataaactcctaagcccagagcactgggagatctcacatctatgaaaacttctcaaagggcggtgcctccaccaggagcagcagcagctaggaacttgacagaaatgtagattctcagggcccacccgggggctggcctgcgataccccaggtgattctcatgctgagaataaatgtgatgctggctctgtctcctgtcaccaccttccgcctggagcctcttgtcctcagtcaacatggctttgccattgcagctgtagggacaggtgagtgggtgaccagatgaccgagctgaaacaggccctggcagtaaggagcctggccttcctgtttggaaacaggaggatgagccaaggaggagacacaggaaaggaatgtcctgccatcttaaggaaggactgggagctccccttttacagaaagcaaacaaatgcttgatttcctaggtgcttccaggcagaaaatagtgatgctcaggaaacagtaaaagcctttctgcaatttttaaaaatcagttctttcctcacttattgattcctagcatttcctaaaatgttcacgtgatatttaaccttcctcatgtttataaaattatagtggctaaaaatccttctgtattagtctgttgtcctactgctttatataaagagctgcctgagactgggtaatttataaaggaaagaggtttaattgactcacagttcagcatggctggtgaggcctcaggaaacttacaatcgtggcggaaggtgaaggggaagcaaggcacctacttcacaaggtagcaggaaggagaaggggaagagccccttgtaaaaccatcagatcttgtgagatctcactcactatcatgagaacagcatgggggatacagcccccaggattcaatgacctccacttggtctctcccttgaaacatggggattatagggattgtcattgaagatgagatttagatggagacacaaagcctggccatatcaccttcttatgatgtctttcatgccacagattatctcagtggtggccaacaagatggaccgaagacttcagaagcaacaggagagctgagggttggagtgttcatcatatgctgagaaaaattcatgtttatagaaagcaccaaaaatattaattacccaaagagagtgagtcaccaggtgctgtcaaacccaaggcagggactcgagttgccaaaaattccagacaactgctgatatggtgaacattaaaaaattacagaagttaagcttgaacaatgtgaaaaaatggcaaataattactctttgaacagacacttatcagggaacctgccccgatattcacgtaggttcttttctattttccttaagcgttggccagcttgagaaataaagggacagactacaaaagagagaaattttaaagctgggcatccggggagacatcacatgtcggtacgttccatgatgccccacaagccacaaaaaccagcacgtttttattagggagtttcaaaaggggagggagtgtgcgaataggtgtgggtcacagacatcaagtactttacaaggtaatagaataccacaaggcaagtggaggcagggtgagatcacaggaccacaggacgggagcgaaattaaaattgctaatgaagtttcgggcaccactgtcattgataacatcttatcaggagacagggttttgagatcaaccggtctgatcaaaatttatttggcaggaatttcctcttcctaataagcctgggagcactatgggagactggggtctatttcacccctacagtctcaaccacaggagacaggtgcacctgggggggctgtttataagcctatacctccaggcacgtattctctttcccagggatgttccatgctgagaaaaagaattcagcgatatttctcccatttgcttttgaaagaagagaaatatggctctgttctgcccagctcaccggtggtcagagtttaaggttatctctcttattccctgaacaattgctgttatcctgttcttttttcagggtgcccacatttcatattgctcaaacacacatgctgtacaatttgtgcagttaatgcaattattacagggtcctgaggcgacatacattctcctcagctgacaggattaagagattaaagtaaagacaggcataggaaatcacaagggtactgaatggggaagtgataagtgtccatgaaatctttacagtttatgtttagagactgcagtaaagacaggcataagaaattacaaaagtattaatttggggaactaataaatgtccatgaaatcttcacaatccacgttcttctgccatggcttcagccagtccctccgtctggggtccctgacttcctgcaacagacactcaaattgttgtggtgattataacaattccacgtgcataccttccccacttccagcagaggtaggtgaagacttggggtcagaagagactgtttcctatgtgtgaatatcagccagtggtgtgatctggtctatcaggaattcagtaggctgaaattccaactgtaaagaacatttttggattccatatataaatggttaggtacaaaaatttgttttctaacattcctcactttgaaagttcattccaatgttttctgtttaataaatattgagaaaccataaagtttccaaatgtattccacattcccttgaaagtgctgaaactttgtttcttttttaagtttatttttgaagcaacttaagttcctcccctccccgctaaaaaagcaggcaactggttaagtatggtgcattaattaaatagtaagatattattagagagcgtgtgcgtgtgtgtgtgtgtgtgtgtgtgtgtgtgtgttcaggttcttaacctgggacaaatttcataagagataataatgagataaggaaaagcttctttctgtattctcctagaataagtttccaggtcaaattacttgctaaaaggacctgtatttcaaaagctgttttcttcatttagttcagtggtttgactgttagtgaggttagaatttttttcagctatttggtattaatttgtattttcatgtctatgaaattatttcatactgataattttttgaaggaaatgttttcttatttacaggaatcttttaaatattaagtatgttattgcactccagcctgggcaacaagaatgaaactctgtctcaaaataaagtagatatattagtgtttaggatgtatatttccttttttatattttaatattctctaagaggaaaattctcttttgattttgaaatgtatttttctgaccaactcgtgtggtcttggtgtgtgcataactaaattttgtttctctccttgcattgactggcagaaagttagagctacatgtaaatcatgcccatagctaactgtgaaccctgaacatttgagacaggtctcagtttatttagaaagtttattttgccaaggttgtcacgcacacccgtgacacagcctcaagaggtcctgaggacatgtgcccaaggtggttggggcgcagcttggttttacacattttagggagacatgagacattaatatacgtaagaagtacactggttccgtccagagggggttccaggtcataggaaggtgagagacacatggttgcattcttttgagtttctgataagccctttgaaggagacagtcagcatatgcatctgtctcagtgagcagagggatgactttgaatagagtgggaggcaggtttgccctgagcagttcccagcctgatttttccctttagcttagtgatattggggcccaaaggttttcctctcacataacatgggggaggtcctggaacgcactctttgtggaaacctccttcccatgccactgccattccgatccttctctctcttgcttcatatctaaatgctttataaatttacctgactttctcatttgtatttgcaaatcaaattagctcctttttagaatgtgtcagggagtaagtaaataagcaatacgagattggttttctgatacagaaacatccttctgcagtgtctttgtttaagagtattttcatatggaatactataattacctacccaaaggatggaaacatttttatggctcttaagatttgggtcaatttatttctcagaaggtcacactaactgataaatgccctcaaataatcaattcttgctttactgcatcctaatcataacagtatattttaatttttaatgtatgtatttgattcaaagaaatgtgcaaaaacttttaatttaatttacaatagagttactttttaaaataggtagaaaggaaagatcgggtttgtgaaaatactctttctctgctttctactgacgtcagttaggaggttcggttatagtcaaatgttttgaaacaattttaaggaattgaactcacaaaaaggctcttcctaggagaggaatacaagtccagcctaactttttaaagtcctcatgagcgtggctgcctttccacctgccgagcaccacgtatgccccacggtgaaatcacacctttgttgggctctgagatgcattcacctgcacttctgtctactctccttgcatataaattatttccagatgattctttcaaaatcataggcctgatttatagattcccaaatgagatattctcccccgaagaaatttgtcatgttaaaaaatgtgcagttgttagtcactgattctagggaaaaaaaaaaaaaaaagattaacggcataaatccatattgatgttgcctatttatcatttgatttttagaatatgtttttcaaccgggcgcagtggctcatgcctgtaattccagcactttgggaggccgaggtgggcagatcatgaggtcaggagatcaagatcatcctggctaacatggtgaaaccccgtctctactaaaaatacaaacaaaaaaaaaattagccgggcgttgtggcgggcacctgtagtccgagctactcggcaggctgaggcaggagaatggtgtgaacctgggaggcagagtttgcagtgagccgagatcgcgccactgcattccagcctgggcgaaagagtgagactctgtctccaaaaaaaaaaagaatgtgtttttcctaaaaatgctgtgtgcactgatggcaataaataaatactgtctgactattttcaggatttaaatttaaattttaaattttaattaaaatttggattttaacttgcaatgtttataccaaaggttctgagtttctgtcatcttaaaacttaaaattaacttaattttcataaaacttcaagttgataaactgagaaggtcatcaatagtaccttaaaaatactgtcaatcagcccaggcaatgtggagagaccctgtctctacaaaaaaattaaaaaatagcctggcacagcggcctgagcctgttgtcccagctcctcaggaggctgaggtgggaggattgcttgagcgggagtttgaggcgacagtgagctatcatcacaccactgcactccagactgggcagcagagcaagactttatctaaaaaaataaaatactatgaatacatatttcaaaattacatttgcttatgaaataattattaaaagtcaaatgttttaaaacaagcattcttcttttgctgtattctgatatatacatttggaaattgtcagcaggttataaatttgtgtcaaagcaaaaatataatcacccaaaaccgtataaaaggtaaaagagaaagattgattggttggtttaaattaaggagcccctgatcttgtttcaaaggaaactcaggaagatatttgggaaacaattataattacttttgtgaagcgaaaagtgtgtgtcacaaggcaaattttctagcacagaaagtaaggtatgaccttttggcttcaggaataatgagattaggtttacaactgatagcagctttcttttgtgctttggaagtcattgttttctaatgttacaataaagatctgttttaaagctacttattttgcctataaataagatgtcatttggtaatcaagggcaattaagttgcaaatgtgctcaccataatgcttaatcgaaaatgtaatgaaattctgaaagagttgaagagttgaacacctgagtttagaatcacaaaactccttatgttcaccttgtaccaatcaaaagacatctatgagcagtttttctttaaaattagaactttgatatatgtggaatcagtggggattttttttaaagatgtttcttaaagatggattttttgtccatctcgctattgaacctgctggtctgagaacctgctggtcaaagattaatcacaaggctgtgtgtgtttgtgtgtgcatgtgtgtgagtgcacgtgtacgtgtgtgagtgtaagtgtgtgtgcgcgtgatgtgtgtgcgtgtgcgcacgtgtgcttgcgtgtgtgtgaaatcagactttgcacgacccactctggaacacattataagagttaatgaaatcctaaatattagctgagattgtgttgaatggatgaaatcttcttggccagctccatttccaaggtggccttttgactccatttgccagagcgcactgttttcgtgtcccaagcgttcatttcattaagctctttctggttgcaaagggcaggcacccggagccaccttctgtagggcaaggtcctgtggagccacgggaggaatcgagggaggcaggccctgtctcagcaagtgctggccgctccccgacagatgcccagaagtccccccaggggtagtggccgcctctgtgaagacactcagagggctgggctgtagccctggtcatcacagcctcagccctggacagctgaattgagcctggcagctgaattgttctccatgttgctgtgagcccactgacaaactcctgccctcagtgtctggatttcacacgccctgagaaagaggatgtgatttatcctctcaatcacccacaaacatgaaatgcgcttgcctggcctcaccccacgatgggtcaggaacgatggccaagagggcaggattttacggggctgagtgtgtcgacacacatgttgttcatgctgtcagatgggcatgcctagcacagacgtgttcaagcggtcagatgggcatgcctggcacacacgttgttgtgaactcttgcattgttggtaagatgtgtgatggatttggttttaccaaaaatggcaaatgtggagttatttttaaggcatacttcgtgtgctatttcttgatgtggttttatcacacagtgttgttttcgtccaccttggtgcaacggccctggtgttgcaagaggaggtgagctctgagcagaattctcacatatctccacttaggacacattgttgagcatcgatgtgtgccagagacttgcagggcattgaaggcagacagtgggctgccctgtgccggctctcaggtcccaagcctggatgactagggcatggacggtgctgtggatggatggtgttggtggtcagccagcacaagcaccacaagcactgctctgacatcccttgcgtggcagacacgttgccatcctctccgaggctcacctgagagtctagtgtgtcggctataatgtaacagtcatgacacgtgagtagcattagccccagtttctccattaaaggaattaaaccgtttgtgacagtcaactcggtgtagcaggacaagcacctagggcaggtgggggcaccctgagtattcaggagaactgttggttgatggagtggaagagacagaagccagggcaccgtggttctggctggaacttgggcacctacaagccatctgaacttgggaaagtcaccttcttggagcagtaatgttgtcatctgccagtcatgggtagtgactgacgacttcccgggattgttagcagaaccacatgaaatcagcaccatgccgacgaccatgaaaactgcctctcatttcatacccgagaaccaatatcttattcattcctaaaaaaggattatctaacatccatggggtcagattagccatacagaggcaggtgcattaaaattctgaattttcaagtgaacgaaaagatcttcctttttccattcggtaaaccagagcaccaccttgatctgaaagcattttgagcctggcgtgatggactttgtgcttctgcgaaagtgtagtataaattccatggggccagccctgcatcctgactgtccccgagggctctctagagaaagatgtcaaggccagccctgtcctcaggtgcagtcagcagactctgaatctgaacccgcgtttggtctcatattcattttgtctcccttttgcccaaagcatcccattccttttctgccacttctctcccaagttttcccacctctttatttttatttccattcaaatatttcactttgacaccattgaactaattcctccctgtaggaggcgctggccaggcccaggaggcgacatgagggcattcagtgctcacagtcgctaatatgtcatctgcttgctgcgggcctggcatggtctaggatgtttacctctgttggctcatttaatgctcaccacgaccctccaaggccggtacaatgattacgggcccttcacacctcggagaagtagtcaggaagtctcccaaggcagcaccactggtatgtggtatgtggtatgtggtatgtggtgtgtggtgtgtggtgtgtggtatgtggtagacccctgcagctctgcagcctggctgtcaagcctctgggttctcctggagcttacgacctaatgggtgtgcatgcatgcatatgtgtgtacaaaagcatgtgcatctgtgtgtttgcgtgtgcgtgcaagtttgtgcatgtgcataatcatgcatgtgtggttacacatgtgcacatagttgtgtgtgcctgtgtgtgtggtgagtgtgtgttggggtggaggtgaacaaggcaggaaaatggggaggccatgacagtttttatgtcattaaaatgattacctatccttgagttccaaatgatatctgccaaacccttccctgattctcccatgcctgccaccaccaccctgccccagtctctcagctgcaccccgtgtacctctctctgtctgcaggaaaaaccccattccaaggactggcttactcacccttttctgctattagactttgaacaccagatcttgcttccgtaggacagggaccatcctgctcatctctctatccccaacatctactgtggagcctggaactcgtgatgcctgtggcttcatggatgcaaggatggaaggatagatggaaggatggatggatggatgaaaggatggaaggaaggaaggaaggaaggaaggaaggaaggaaggaaggaaggaaggaaggaaggacaaatggataaatggatggatggagtaaatgtcataggaaaagtgcagataaaattctaatattcagagaaaagagagctaaatttaggtgggagagtttaagaagatgctcataggagaagaaagctcttacaatgggtcttaaagatggatggagtggccataagtaaggaggtgaatcagaggaagatactgcggggggaacagagagctgctgtccatggtaagggcagctgtagcctcatgcaaagtgcctgcatttgaggatgagaagctggcctggggcacctgcagggctcggggctgctgatgctgctggggctgccgaggcactcatgtcccatgcagcatggcctcagtcctccctgcattccctgccttttcttccttttccttcctgttttctctcccattcattctcaattctctcttctttttatcactatctgcatccacccaaatacacttaactaattaaaatctctatagtgtgttcaaaagttatttctcacctgcagtactcccttgagctccaggctgtccgttcccccaatttcattatgcccccaaaaggctgggcacattttaaaacatgttctctccacaaacacagaattccctgagcacctaagcagaattgaatggagaggaaatgaagaacatattaacttcctcttagatccccgggctgatttctttcaggctcagggctcagactgcatgataagataaccattttgtgaaaagatgaaagctgctccgtgcagggcgcattctgtgcaggtacagaacagatagggaggggcttatgtctccgtccctcctcccccgctcccatgctcaccgcttgctttctgttgcgagtgtctagaatgccctggccctcttttctaggaattggattgtaccattgtcattccaacctctcttatcagaggcaaagccccagggtgcagccctccccgcagcgtggccacagccactcagaactccagagagtcacgccccgggtggacatgtgtgtgaatcatcagcacagcaccctcagatccccaccctgaggcacagcccctcgtgtcatgacagctgtcactcatcttttttttttttttttttttgagacagagtcttgcttttgcctaggctggaatgcaatggtgcgatctccactcactgcaacctccacctcccaggcttcagtggttctcatggctcggcctcctgagtagctgggattacaggtgcacaccaccacgcctgactaatttttgtatttttagtagagatggggtttcaccgtgttggccaggctgatcttgaactctcaacctcaagtgatccacctgcctcagcctcctaaagtgctgggattccaggcatgagccacggcacctggcctgtcactcatcttttttcgtttgttttcataactaacagcatgtccaccaacagactctgagagagctcaggcagcacatattctctgggacttaatcgctgctgttggccggatgccttccacattgagatgcaatccacagacaagttgtcaagtccatctgggtgaggactccgaagaggaaaacaggttaccacgtggttagccacaccattacaacactggcgactgttcctatgatggacggctctaatctcggtgcactgggagataacaagcccatccccacgagttgagtgagaatttaacttgtgcctggagccagaagcgcgacgcagagtggactggggtgcactgagccttgccagggtcccgcaccctcaccgggagctgtgatggggccaccttctccctctccaggccccactttcctgtttgaaggatgcccgccctcaccaggagctgtgaaggggccaccttctccctctccagactccactttcctgtttggaggatgccgacagcgagacctgcccacattgcatcgctttgcatgtctagctgtgcttgatatagaagaccttctgtgtggatgtgtgacacacctcagagccagcaggtgggacacagctgtgccatgagcaccacggcccgtgtccttgtagggcctcccttccctgccttcttcctgtgccccccaagcccctcagtccatcctcaacagccagggagaccccctcaagcatcagtggcttcccatctcttctctgctcctatggcctccagactcagaagcccagcaaagtcctgttattattgccagccccacccttcaggacccagacagggcctcctcttgcctgctctccctgtggtcctcctccctggcagtgccgccacaggcaccaactcagagctgtggacgcaccgtgcctggaaccctccacccaggaccctcagagatacgtcctacttccttaggtctctgccctggtcaagccctccccaccacacttgtcccagcgggtaaaggcccgaaacatggggtgatgagccccttgccccgcgttttttagagtgtttgtcactgtctgacgtttgcctgtttatctgtttattgccggtaccaccacccaactgaaggctttggagcaggggctgtttcactcactgtctaccacggtaccttgtttgcagcaggtgctttgtaaattttgtttgaatggctgggttgagtcattaatgaaagagagggaaaggaaggcaggaaaacacttttaaaactcataccacagaagatctatctaaaacctctccaattctgtaattctatgacctcatgagaaaagaaaaaaaaacacccacctagtgaccataatgtagcaaacttcctgccgggctgggcgctggagtcgggtgtggctgcacagctctgctgccttgcagaccactccagggagctgccgggagctggacgcatgctggtgtcttaccccacggagggggcatcactgcggacagagcccagcgtgggcggccgtgaccagcagtgcttcctctcagaagctgcctgtaccttctggaaatatgaaatatggcaaccatacaaccatttctggataatacagttccacctttgaaaatggtttgaaaccacacaaacatccaggtctcatctatttggggctaagattttagaaacagtagaatttttcttacaaaacatttaaataagaaagtacaaagcggctcctgtgagcacagcagcagaatcgtttccacagaattcggcccagggatccacagtttggtaaccagcacaggattttctacagagcccaggattttctacggagcccttcctctcaagagcatcagagtacttgagaatattaaccatgtgttattcggagcaattccagccttggaaatttgcggaggatgtaaactttgccaactaacctaggggagagcttcacccaaattcttacctccactgagcccctaatgcacacttcctctttgtgtttaatccatttatttgtttaatacatttatttattcattccattatcaaacattcattgagacctctgttggtagtttaagacattctgctaagtatacagcatgactcagattaaaatggccgttggagacacaatatcaaacataaaaactaatgtaagacaaggcagagcataaacctggtagctgctgatatttactgatatcagtaaatatcctgagctgcaccccagaggtatggtcttactgtgcctgggatgatgtccagaaatttgtcctttacacacttcctgggtgatgctgaggtatagcctcggtttaaagccctttgaactatggaaaaataaaggcaaacctcaaacagataaggaaatgcaagatctcagtgagctgtcccaggaccagatcttggatcccacgactgggaaccagcagagcccactgggttctagaacctctgccagctcacccagacgagatctaaggatttcccttaagctttcctcagcagttatctggatggtggattaagtaaccatcagccatttgtgtgtaactcaaactcacattatcgggtcagttaacagatttactaatttataccttgcttcttttcatgaggaactgaagcgagaacagaaacgtgtacaatggaatgatggaatgtctactgactccacaatcatggtcacggaacgttaagtgagaatgaaggcaaagaaaagagatgtatatgactgtcacaggacctttgattattgatttaagagcctcagatgtttctctgagccatatagtgatcagagcaacacaggaaacagcttcagccacattctttgttctgtggagaaggaggagatttagaagcaaaaaataaacataactgctttcctaaatgttatgaaacagatcttttcctgagttctaaagcaagtgaagaaaaattttaagtgaagtgtgtctatattcaattttgagtttctgtgtatgtcttccttcatcacatgcgtgtatttattttattcgagctttatggggatataagtcacacaccataaaagtcacgctttaggatgtacaattcggtagcattcagtagatttacaggtatgtgcaaccatcgctctaatcaatttaaaacatcttcaccccaaaaagcaaccctgtgccttagcagccgcctgccctctcacctaccctgatgctgggaatcaacaatctgttttccattttgagatctgcctgttctgcacacttcatatgaatgaaattgtacattggtggtcttttgtgactggcttctttcccatggcataaggttttgaaggcccttccctggtgcagcacgtttctgggcttaattggttttaattgctgaaaacatttccattgtgcggtacagcccccatgtttgtccattcatccgtcgggcagcattgaggtcgtctccactttttggcaactatgaatgatgtcgctgtaagcattcttacacaggcttttgcctggatgtgttttcatttctcttggatgtgcacctcggagtagactcactggggcttttggtgactctgtgttcagcctttttaggaccctccagcctgttctcccttccccagcagcgtgcgaggttccagtttctctgcatcttcatcaagctttggaactgtgtccttttccctctgtccactccagggggcttgagtggtaccgcactgtggttttgatttcatttccctactggtgagtgattctgaacgcctttctgtgtgctctttcgccgttaggacatcttctttggagaaatattcagctcctatgcccattattatttggattatttgtcttattataatggagttgtcagatttatatattctggattcaagttccttcacaaatacgtgatttacaaaaatgtttcccattctgtggatggcctttgcatttttttgatggcatcttttaaagcataaaactttttaattttaggtagtttattttatctatattttttcctgtgctttggtgacatgtctaagaaaccattgcctggttcacagtcacaaagaaatgcatctatgttttctacaaatagctttatagtttgagcccttttctgtctttaagccactttgagttcatttttgcagattttgtaagatgggggttaaattcattgtttggtgtgtagaaattgggttatcctagcattatttgtaggagagactattctttcccctctgggtgaccttgtctcccttatcaaaagtatcacatgtgcaggtgcatgtctggactccagttcagttccatgggtccatgtgtgcatccttgtgtggggccccacccttttgattactatcactttgtgactcttgggatccataagtgtgagtcttccaacctggttcttctctttcaagattgtttttgcttctcaggacccattgcatttctatatgaatttgaggattggcttttgcacttctgcaaaaaagccatgtgaggttttgacaggaatttcagggaatctctaggtcacttggggtaggacctacctcatcttaaccattaagtctgccaatctatgaacataggatgtcttttcatttacgtaagtcttgcttaatttctttcagtagcgatgttttctagttttcagtgtacgaatctttcacgtcctttttttctttttttttttaagagacaaagtctcactctgacacttaggctggagtgcagtgatgcaagcttggctcactgcagccttgaactcccagactcaagcaatcctcccacattagcctcccaagtaactgggactacatgtgcctactactatgcctggctaatttttgtatttttttttaaagacagggtttgccatgttgtccaggctggtctcaaactcctgggctgaagtgattcccccatctcagcatcccaaagtgctgggattacaggtgtgagtgactgcgtctggccctcttttacctccttggttaggcggtcccagggactttattcttttagatgttattttaagtggaattgcttttctaatttcctttttgggtttctcattgctaatgtatagaaatacaattgattttttattttgctcctgtaacctgctcctttgctgagcagcagtgaaagtgggcatccttgtcttgttctcttctcacagggagagctttcagcccttcagcattgagtatgatgttagctgtgggtttcccataaatgcccattatcatgttggggaagttccctccagtcctagttctctgagtgtttttatcatgaaatagtgttgtactttgtcacatgccttttctgtatcaattgtgttgagtatgtggccttttcccctttgttctattaaagtgatttattacattgattgattttcctatgttgaaccacccttgcattgctaggataaattctacatagtcactgtatataattctcctcatatgctgctatatttgatttgctagtatttttgaggattttttttttttttgagacagaggtctcacttttgtcgccaggctggagtgcagtggtgtaatcttggctcattgcaacttctgcctcccgggttcaagcgattctcctgcatcagcctcctgagtagctgcgattacaggcatgcgccaccatgcccagcttatgtttgtatttttagtagagatggggtttcaccatgttggccaggatggtctcgatctcttgaccttgtgattcacccatctcagccgcccaaagtgctgagattacaggcatgagccaccatacctggactatttttgaggctttttgcatctctatttataagggatattaatctatagttttcttttcttgtctttatctggctttgctagcagggtaattctggccctgatagaattaccatagaatgggcttggaagcattcctgcctattctagtcctgggagactttgagagggatcggtgttaattcttttttaaatattgatagaattcacctgtgacaccatctggtcctgaacttttcgtcccacaagcacggcgtgcaccctgtaaacatttgctgcattcttcatatttttattgttatacttacaatatgctatttagattgggtaggccggccgccccataagtgcaacagtaagacgtgcatttacattctattctgaatttggggagatggttgtacgttcatgaataaatgactataattgctgttttctctcaatgacaaaaatggtgtcatgaagcagtggaaattaggaaactaagatgctttccgcattttgtgtttgctacctcattttcacaaaaagaaattaccagcccctaagtatttattacacattgtgcacacctaaaaaacccggagacctagcttagtgctcgttacatgttctagtgttgccattgtttacagcacgctgccattgtcattattgtgataatattttaaagtacatgtttccatgcatccatcaggaaatccagtcctgtatagtggaaatgagaatgtggtatcaacatgtggcataatcaaatttaattcatttcagttaaattttatcttttatgccattcttttatgaagccacattcataacatagcttctaggctaaacattaggcagaagtaggatacgtgagtggggcagtaatggactctctttttaatatgaaggaagattaaaattgtattaaattacacgttaatggaaaaacaaagcaaaagataataggatgacaactttatgcagctgtaaagtctggattacagcacatagttttgctatttagcagttgaatattgaatttcatttgaaaatttgcttttaattatattaaaataatatctaaatattcccccaatatattaaagtgctctcattataatttgactgtttgagaaaggaagacgccgccggccattacagtgtaggtgctcctgtgagacagcgtaggcacctgaaatataacacagtgaggctcaccttgaagttaaaggatctctttatccttcaactggggactgtttactgtgagaatatgcaggagcaatccctttgctggcctcagtgggagaaacagccccacaccttgctgtcagtctctcgggatccctcaggaaatctttacgttcccttctgcattcacacctgggtgtgagaagccggtccctgacttcccagggactcatgaaatcgtatcccttccttatcccatgtttccatggccatgctggcccagacggctggccgtcctggatcctgaaatctgcgacgttttgaggccatacctaggactagtcacttggtaaacattatcagcaggggattttgttgttgttgtttgtttgtttttgccttggttacctggagggttggggttggacacgatgggaaaactctcactccccatcactctgcttgctttccctggcatccatgttgctcagggagtcagagtgggtggctctccaagcgcagggcatgatggactcaccccaagactgcaagcaggggtgcatctcaggctgcttagggtggtggcgagagaggagcaagtgggagagacgcttatggtgacgggagagctggcaggcaggaattcgttccgggatccgaggcatggaggtggtccaggagaggcaggtattggacaaacgtgtggggggatagttcccttcctgaggagacggccacgctcagccgtcgaggtggccacttcttgctcctgtctgggtctttggcctcgaggacggcacacagcaaggccgagtggtgtggagccgggtcttggagtgaatgcagggatgcattccaggcctgggaggagaggcggcaggacccgggcagcgacatctacaaatgacggcagccgggtgtgcttaaggctcagcagactcacagggacgtgcggaccgtggggcagagggaggctcggcagctcctctggtcatcacagagcttggacgtctggtctgggcctggcactgctgcgggatggcccgtggctgtcacaaggaaggcagctgtgcccgcagggagcttgctgtcctagatgtggccctgggtgacaggctgagaagaacagggctcccctaaaagttggtggatgggctggggtgcatttgagggggtcagccccacagctgtgtctgggtggaggcagggggagagggagagagaggaggaggccatcgtgatggtcctggtgacaaggaggagggtctggggcaggaggggcctgggatggaggaggcagatgtggggttgaggggggcctgccagaaggaggaaggtgtgagtgcagagaccaggggagcaacaggccgtggagctggcagatcctccttctctgcaggtcaccccagcgcccagccgccttcccagggagagaggagagagcaagcgacctgccccttggtggctcagtggccataagacaggtggtgctttgttgtagccacagcctcgctcctccaggcattcagggaaagcccatcacaggccgcagaaggacacagggaggagtcaagcgggattcctctggggaaggaggcacagctgcccccacacagatgggacctcgagaaagctcctcccatcctcactggcctgtaagggtgtggactgaacaaacgatttcacgattaatacctgtgtatgtgatacatgagcttactagacaatatcacccatcaagtaccagatgctatttttaaaacttcttaagctgtacgacaaaactgaaatctatgtgaaatacaactatgcttttcccccaaattgttaatttcctttaataccacaaaatccggctgtcaagagacctgttcaatctactagatgctaaatcttggtcattaaccatttgggaacatcagtgtttcctctccactcctcacactttgcgatataaaaacaactgcctggccgggtgtcctggctcatatctgtaatcccaggactttgggaggctgaggccagtggatcacctgaggtcaggagtttgaaactagcctgaccaacatggcgaaacctcgtctctactaaaaatacaaaattagccgggcgtggtggcaggcgcctgtagtcccagctactcgggaggctgaggcaggagaatcgcttgaacccgggaggcggagcttgcagtgagccgtgatcgcgccattgcactccagcctgggcgacagagcgagactgtctcagaaaaaaaaaaaaaaaaaaaaaaaaaacccacaaatctgccctctcgagtgcccaggccagacatggacactgattaatgaagtccacggtgggggtcacatattccccgcacctgagggtttccgccgcgcttccgggtgttcaatgccgtttctgtttccccacagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtaagcaggctcacggccctgtggaggccgtctcggcacagcaggtggtattgtcgttattccttttttaattgacagataacaactgcatacacatttaggttgtgcaacaggatgttctgagctacggatatgttctgggacagctccactgagctgttaacacacgcattaccttacatacgtaatttttttggtgggagcacttaaaatccactctggatgatttccacctattcaatacgtggttgttaactgcagttaccgtgctggccaacaggtctcttgagctgacccctcctcactgaaatgttgtcctttgaccaacatctcccaattcttccccatccccagtccctctggtaaccacggttccactctctgctcctatgagttcagctgtttcagatgccacccgtgagagggaccatgtggcctctatctgtgtgcgccgggctcatcctgctttgcagtttcttccagctcacctgtgttgtggagaatggcagatctccttctttcaaagactgagtagtgtcccctgtgtatgtaccgcatcttctttatccatcatttgccgggagactcgaggattgacggcacgctatggctttgtgcgcggggctgcagggatggcgggacgttatctacgggcagctctcatgcgtgagtctggcctgctctgggagggcctctgaagatcccgactcctccttggaaccatccctctaaacacagtgggccatttctttaaggcctctaaggctggagggtttaacaaccacagcaaacacagacttgcccatgtgggtgttttccatgtgagagctgatggaccggcctaatggaagtgggcctgcgacattcgtgagttcactccctgcacctggccacagcctctctaagcaccccccactacaaaaagcctgattatggaaaaggcctctgtgtctctggggtgtggattaaatgaatttaccaaaggcaaaaacaaagaaggtagatccctagagctggcatattgcagaattccctgttttatgtgatttcactctctgtctctgaattgtgccatgcctgagtttactggagaagctctctgggaggcacacgctacttctgaggatgccactcagtgacttccatcagtcgatagcgctgttaaaaaaaacataacatgtgtgtcccaactcacaaatcactcttgcttgcctagagcagcggctgtgggcctcgcatcagcttagagacatcttcatggagtaatgggccattgctggctgagccaacaggcagtcaactaatgggacagggggactagcagccgtgattctttctgggagtcgtggtggcaaatccttccagtggcaccgtcaccatcaggtccagcgtccacatctcaacagctctgttttgaaaggaaatgctaaccaaattgcctttgcaggcagatttattcagagacaaattggtagttgcataaaatattattttatagcaatggaagaggcataaattttgtttgccgtcggcaaaccctaatcatatccaaatgtaaaagttgtgtctgcttgtttagagaagcctggtagaaagaatcggggttcactctgatctgtctcctcattgtcacagacacatagctctcttgtttttgtctgtgcctggtgtggatagtcagtgttccctgaatgagcacttcaggacactgtcagagcctccaggttttgccccagggtcacctgcctccaatgcctgccactctccccaagcccctccagctgcgccttctccacaggtcctgtgccccttggacctgccttctccaaggagcttcttccacccacttcctcccaggaacacgcttctctctgcctccaacagctattccacggtctaggtgcagggaataccagtcgtccacaaaggtgaagtgagacagaatgaacccacacaccgtcagcccctttcaaaaaccatccctccgaaagtgacctcattccatctgcactcacgccttcccacccaggctacactgcaacaaatcccacacgacagacagatacaactgtaaatatgcctgtgttgatctcccagagatccacacggaatgatgagtacgctttcttttgaaacataaccacctgcattatatcatcctggtcagtggtcacattcccctgagggctcactgtctcttgttggcttttatttgaatcaggatccagagaaggggcccgcctggcagctgctgatgagcctcttcatctcgttcagcccgaggtttctcctctctttcctctcttcctccccctagattttttttgtttggaaccagctggttggtctgattgtgtctgtcagtctgagttccgtgccatggggtcattccagacactctggtcctgttgttctgcagccagccacccactcctggacttccctgccctgacgccactggcctccctctcacgtccactcagatgacacatcctcggaaacaacacagagcgttatcgtgccgacattgggaagcactgcccggaggatcggaggatagaaggacgtctgcagggagcagccacggctttcatggcgctcgttcacaagggcgttttcttgcagtagcaagcttcccccatccccacatccgcctcccagtgaaaccacctcttcggggcatgcagctcggtgacttctctcccctcctcactgtcccccagtggttgctgctggacccctcatggaaggatctatgaagctgaatatcaggagctgtgtgcaacctcctcgggctgtttctgtcctaggactcagctggattgacgtctggcattttcaaagatgcctgtgcagggctgtcccttcctgtcaattgcattaaactttctggtggaaaactacaggtttctgggtcctcacaaccccagattttatttcgcagccaggaaacagggaaactaaaggaatttgtctgtgggtcctagtgtacggataagatttaaaagaataagaagagagaaataaatgtttataaattttcttccttttttcactaggagcacttgcagctgaacgacaggatcacttttcattttcacccttggtttgtacagagtatgtggttcacattagaggaagatttttttcttgtttttaagtaggtcaaaacggagaataagtggaattgaaaggcaattcaggcctcacgttattctttcacaaagctcttgttttcatcttttctgcatcagcagactaagcatctaaggtcaaacttttcatgagcattgtaggaatgcagaacggattcgccgtggcttagctcaggatgccaaaggctctctatgccacagtccaccgaaactcccagggacgtgcagggagggagagacgccgcctccccgggaaggctcctggcggcatcagatggagggacagcggggcccctgctgcatcccagagaagacccggcagcccctccagccctcggcctctgtccccgcctccttccctcctgtcctcaggcctcctctctgcagcctcccagtctcccaccgcgtcctgcgctcctggttttctcctcttctagtgtcttccccacctggcgtcgcccggccgcaaccctggccctcctggggaagaggttcggaccctactctttatttgacatgaagaggttcggactcccagttttattcggcatgttcacgggcagcagccccattttgtttggcgtgttcacgggcagcagccctgttttattcggcgtgttcacggtcagcagccccgttgtgcttggcgtgttcacgggcagccccgttagactttgggttttacctgtcaggctttttacatgttcacgtgttggaagcaaatggcagaaaagaacacagaggggagggggtgcgatgaaaacggggagccctgagcattccctccctgcgtgtaaagtgtttcagaacctctccctgctcccgccctctgcagccggtcccatcactgagtactgacctttccttgcagccattcgctgaaggacgtgttgcgggtcccatcaccgagttctgagctttccttgcagccattctctgaacgacgtgtctgttttgtaggccgtgcagatccctggctttcaggctcagctactgcatttgtgaggtttccagttaggtacaaaaacacatcttaaaagtcccatctcccaggtcaacaggtcatccttgcggtgtagtttagaaaaatcatccatcttttacaaaatggagccaggctcccctgtttcttgtctctacaataagcatttaaaaggcttgtcacagggccaggcacggtggctcacacctgtcatcctagcactttgggaggccaacgcaggtggatcacctgaggtcaggagttcaagaccaacctggccaaaatggcaaaaccctgtttctactaaaaatacaaaaactagccaggcctggtgacaagtgcctgtagccccagctactcaggaggccaagggctgagaattggttgaacgtgggaggtggaggttgcagtgagccaagatcacgccactgcactccagcctgggtgacagagcaagactccatctctaaataaataaattaattaaataaataaataaataaataaaatggtttgtcatggaatgcacgatgctggccatttgcttctttctgcccgatctggggtggaacctgagtctcatcagagttgggtgtggtggcctgggacagcctgggccacctctggccctcctgccacaggcccacctccacatgctgggtgacccctccctgctggtttccttcacgccctcagctcagcttggcctccaccttgacctttattgagggtccctctgctgcccatctgcctcctgagcccgggtcctgtctttgtcccgctttgcccctgtatctaggagggtccaacacactcagtaacaattagcgaggggcacctgtatcctgcagcgttccagaggatgctggcttgagcataagggtctctccgggcacctaggtgtcccatgttccagaacttggcaagcaggaaggacccacgcgccccagccccccctcccccgcgcccaccaccctcacggtatccccaccagttcaggaaggctggcgttgtggcttatggggtgctttcaactccagaaaaccaatagttctaacaagcttctcagaaaacttctctgtatttgtagttttaggggcaaaagagggagaaaggagattgctgtggttggttcctatccttagcgataccagtgctcagcagaatgaaagaactggccagcctggctgtgctccactctaatgcacgtttgcaatttgaaaggagggcttttgttttaagtggctcatggtatagatctggggccgtgaatggataggagagttggggtgtggccacacctcacttccaatcccgtagtggaatagcaggtccgggaggagcttctcatccccttttaagccactctggacacagacgcacaaccctgcacaatccttccgcagcccctcgagtttctggtctggatctctcctgcactgacacccagccaccagctgccccatccatccagtgtgagtcctaaaacgcctccttgagacaaagcggtgacctccgcttccaggagccacgtgtgcctgccccccacactctatgttccctgtcctgtggcccaggccacaccatttcctgactgcaaagcctgtgttgtgaggggctcctccacaactgccctgcctctgggccaccgcttccccccggccccgactgccacagaatcctctcccaccttgagtaccgtcacacagggcttggcaggatctcgctggtgctcaccgagcccgttcgtgtaatcagggaccgtctgcaggagtgcaggagctgggcctgtgccttcgagcctctcactgtctccccggctggactcctccatcaccccccagttgtcctgggactcggtgtgtcatcgctgggagcagcttggtgccgggcaggcagggagatcgctgggctgtgtcacatctcagtgacatcatcttaggacccaacacattcttatccccatgacggaaattccagcaatgtttgttgaaatgctgatggatgttgaagggtgtctggttttgggttgttggctagccttgtgtctggtaaatctttctgcctcttcaatccttcacgcctccgtttgtggtgagattcaagacagtgttccgaaaagcacattggaaatcataactcatgtgaacatggaacactgggtgggtgcatgcgctgttttatccaggtttaccaggggagaatgacatggcctacatgtaactcaagatggtcgtggatgcagagacctcatggtgactgggtgcagaaaccttgtgacctgtgactgggtccttggattctgtgatctaagaccctgaggaaccatctgcatttatgccatgacggccaccgagtggtcaccttgttctgggcacagtgccctcaacttggcagctgaggctctgcttctgcaggagtgcaggtagatggggtccggctctgtcctctccctcccagggcagatgaggctctgctcctgtgggtgtgcaggtgggcggagtcctgctctgtcctctcccacccaggacagctgagggtctgctcctgcaggagtgcaggtggacggggtttggctctgacctcttcctcccagggcagctaaggggtctgctcctgtgggtgtgcagctgggcggagtccggctctgttctttccctcctagggcagtggatgccccaggcttgtctgttcccgctgagtctgtgtctcctgcctcagacttggtggtccacatgcagtactgctctgtgaatgatcctggaagggctgacccaacccaaagtacagcaggactaggagctgttggagctcaggccggtgaactgcaatttaagttatcccttgtctgtcttggtgttaaggagtggaatggaatcaagtttgtccttaagaaaataaagtgggcagctgaactctaaacctaactctgacttggtttcagtggctcagaggaaaaaccacaacaaacaaacaggaaaggaaagacttcccacccaagctaaattgttgtagggacaccagggtggatttgagcagcatcgcgaagatctcttcagctgagatgtacatcccgggaggcagcagccatgcacccagcatttctcaagctcagcacagcgggatgggggctgggagatgcttgtggggtcggtcttatggaatgggggatgttgagcacagccatgcacccagcgtttctcaagctcagcacgggggtgggggctgggagacgcttgtggggtacgtcttatgcactgggggatgttgagcagcatttctgggctccacctactacctgccggaagcacccccatttagtgacaaccaaacatatctccagatgtcaccaaatgtcccctgggggcagaattacctggttgggaactgctggtgtcatccaaagagcgtgagctttagaacaagacagacgcgtggaaccttctcacaagctgtgcagccggggggctcacaataggggctttccatggaaataaatggctataactgtgcctgcctgacctccctcagggtcccggaaagagcccctggtgagatggacgtgccgatggccacgggtgtcctctcaacaaggagatggtggctgaggggtgaggacacaggatggggcagagggcaggggtgagcagcggggacaggtctcggccgattctgagagaactcaggtgctgtgtgaactcaggggtctccgcaccgaggcaaggagtggccgtcctgccttcatgccgccagcctgggtggtgcgtgagtcagctcgggtgccatgacgggcatacacacccggggggcgtgtaaaggcacattcattccgcagggtcctggtggctggtgcccaagaccgtggagtcccaaggccagctcctgctgagcctctcctgggcacgcagacgccgtcctctccccatgtcctcatagggttgccccctctctgtctgtctgtgacctcatctccccttcttaggaggataccaggcagacaggatcagtgcccaccctggtgacctcattttaccttcttcacctctgtaaacgtcccatctccaaataatcacattctgaggtcccaagggttagggttcaacataggaatttggaggaacacaattcaggccataacttgtgtgtccttcccaaggaggggtgtggggaaggcagctttctcccgctgaatggctgagggcatgccctggagagactcagccattggctggcacctcctggcaggttggagcaggcaccttggtcctcgaggggtgagtgtggcatccacgcatcctgggggctcccatgtgggtggggttatgccaggcatgcagcgcctctgttggtggcctcctggtgtccatgagcccgtggctcccattccaagcatgagggcgataggagctggacggggccaaagggcccagtcacgtgtgcccagtcgcaggcggcttagatgggggttttgtacactcagctgtagtgtggcccacaggtttggagatggccataggaaagacagttcacaactcacagccccagaagagagtgaggccacaccgcaggcctgggggacacacctatgggtcaggaggcaggagaagagggaagcgtgggcaggagcctttgccacagtctctgggaaggagggagacacatacaaacatgcacacacatacacacataggcatgcatgcacacccatatacctgcacacatacacatatatgcacattacacatacacacacatacacacataggcatgcatgcacacccatatgcctgcacacacacatacacatatgtgcacattacacatacataaacacacatatgcacataggcatgcatgcacacccgtatacctgcacacatacacgtatacacacattacacatacccacacatacacacataggcatgcatgcacacccatataactgcacacatacacatatacgcacattacacatacacacataaacacacatacgcacatgggcatgcatgcacacccatatacctgcacacacacatacacatatacgtactttacacacacacacacacggcttaaaggaatgcagaagacatttccctgtgggaacgcacagcaatggacgataatgtttttcctcggttccagtgcctccaagagaatatgatgatataatcctggcccctttcacctgggctttgcagcttggaagaaagaaaagatattccagtttgtgcagtgttgaactatccctaaagcaagtaacaggagacgtcaaaatgtatgcttatgtcacccttatgaaaatgcctttttgttagaaattatgaacatcacccatcactaggtacaaggaggtaattagggtaattgattggcgttaaatgcagcagggactgcaaactggatttgcagagtctggtagccgtcgtggaaagaaatttattcattccttcactgaaggccataaagccattttggtttcagagcgtgcactaggccaccctgggctgagggctgcagggttcgaatgctgtaacataacggagagagatttgtttgctgaggcaggctggcattttagtattgctcttctgttcttttgatagtctccagacatatgctttggaatggggatttggtacttgaattcatgctttgaaattgactctggttgacattctttctgtattgaaatttcttctgtcaaagcctgcgaaattggcttcttaaatcagaaacagaaacatacaagctggtctcatttgttagttaatttgcaggctgctgaagaaaaaaatctttactttgttttttatggaaacatgtttttaattcacaaaaaaaatcccataaacctgccaaagtgaatctcttctttgatggcagaggagctgctcttccatctgccaccagccagcctcagcctcccttcccgaactgagcttttcacacattcccaggagagtggcagcgtgagctcccccgtgcccaggaactgggtggccgggcctccttctgccccatcgcctctgcctgcaccttctgctggtccagctcagacaaaagtaaacccggacctcaccccaggacctttcctgatcctggcccctcccgtcagccgacagtgaccttcaacacgtgtcccctccacactggcttctccaccctgatgatgctaccactcatttcatgtccatctcctgtaccgaattgtaatgtcattgagaactgtggcttttcttaaattaaaaataagggtgtttattacaaaagtcatatagggttcatgtagacaatttaaaaatataaagaaaagtcattgaaaaccctgtaatcttcatctcctagtgacggtccctgtttcacatcttctggctgcttctgcacataacacagttacatctttaaaagacataaaaatgtcaagtgctttaaaaattgcttttccccctcatgagcatcttttcatcactaaatgcacattctggaatagtattttgggtagctgggtagtatccatcctgtgcttttcgccctcgtgagcatcttttcatcgctaaatacacattctggaatagtatttttggtagctgggtagtatccatcctgtggttttaataaatattgtaagccatcccctatgatacagtactgttgtcatttctcctctttccctgattaccaattccccagtccctgaccctgggctgcattgtcttggggaagcttcatggaaggaaagttgcccactctaaggacatgaccagtccgaaggcctccagtcatctccagaaagaccgggcgctccactgcccgccacctggcctgaagacacggagataagaattgtcaagtccccaaagttgtgaattctttattcttccttagtcatctttttccagtgctcaaacttcctcactgtcaggaaatgtaaaccaaaattcacacggacaaaatgtgaacaaaacattggcaaatgtacacctgttttcttaactgctgatttcttgctgagagaacctgctgtggctgaggccccaggcctgtctcttacctgacctacagctctgcagctctgcggtgtcatctgtgggacatttacattgaccatgtcattaatacccgatatggtttgtgtccccaccgaaatctcgttttgcctggcagctcccataatcctcatgtgtcatgagagggacccagtaggaggtgactgaatcatggggtgggtctttcctgtgctgttttcatgatggtgactaagtcttatgagatctgatggttttttaaaagggagttcccctgcacacactctcttgcctgccaccatgtaagacatgactttgctcctcattcgccttctgccatgactgcgaggcctccccagccacgtggaactgagtcagttaaacctctttcctttataaattgcccagtctggggtatgtctttattagcagtgtgagaagagatgcatacaatacctccaattccctttcagcgcggtctgtattcctctttgaacacgtgcagacctgggcacaaggcaccaggtcataaaggctttagaagaacccggctggagagcaccacagacaccgcctgtccagctcacggtcacagttcaggatccttgtcctgagcctttgggcctcttggaatctgggtggagggagaatctggaacttcccatcctgtccaaccctctcctcatcacagcatctggatcttctagtgtgcgtggtgctagggtgtcactgtgagctgccgtgtgcctgggccaccttgggggtgctacagctgtgatccacctgcaccgtgacccacaggggcctgcgggactgtggtgttgggtgtccgcgcctcgttactgggggactgtgtggtgttggggtgtccgcgcctcgtttctgggggactgtgtggtgttggggtgtccgcgcctcgttactgggggactgtgtggtgttggggtgtctgcacctcgttactgggggactgtgtggtgttgggtgtccgcgcctcgttactgggggactgtgtggtgttgggtgtccgcgcctcgttactgggggactgtgtggagttggggtgtccgcgcctcgttgctgcgggactgtgtggtgttggggtgtccgcgcctcgttgctgcgggactgtgtggtgttggggtgtcggcgcctcgttactgggggactgtgtggtgttgggtgtccgcgcctcgttactgggggactgtgtggtgttggggtgtccgcgcctcgttactgggggactgtgtggtgttgggtgtccgcgcctcgttactgggggactgtgtggtgttggggtgtccgcgcctcgttactgggggactgtgtggtgttggggtgtctgcacctcgttactgggggactgtgtggtgttggggtgtctgcgcctcgttactgggggactgtgtggtgttgggtgtcggcgcctcgttactgggggactgtgtggtgttggggtgtccgcgcctcgttactgggggactgtgtggtgttggggtgtccgcgcctcgttgctgggggactgtgtggtgttcgggtgtccgcgcctcgttactgggggactgtgtggagttcgggtgtccgcgcctcgttgctgcgggactgtgtgttgttggggtgtcggcgcctcgttactgggggactgtgtggtgttggggtgtccgcgcctcgttactgggggactgtgtggtgttgggtgtccgtgcctcgttgctggtggactgtgtggtgttgggtgtccgcgcctcgttgctcggggactgtgtggtgttggggtgtccgcgcctcgttgctgggggactgtgtggtgttggggtgtccgcgcctcattactggggggctgtgtggtgttggggtgtccgcgcctcgttactgggggactgtgtggtgttggggtgtctgcgcctcgttactgggggactgtgtggtgttgggtgtccgcgcctcgttactggggggctgtgtggtgttggggtgtccgcgcctcgttactggggggctgtgtggtgttggggtgtccgcgcctcgttactgggggactgtgtggtgttggggtgtccgtgcctcgttactgcggggactgtgcagtgtccgggtgtccgcgcctcgttactgggggactgtgtggtgttggggtgtccgcgcctcgttgctggggggctgtgtggttttggggtgtccgcgcctcgttactgggggactgtgtggtgttgggtgtccgcgcctcgttgctgggggactgtgtggtgttggggtgtccgcgcctcattgctgggggactgtgtggtgttggggtgtccgcgcctcgttactggggggctgtgtggtgttggggtgtctgcgcctcgttactgggggactggtgttggagtgtctgcgcctcgttactgggggactgtgtggtgttgggtgtctgcgcctcgttgctgggggactgtgtggtgttggggtgtccgtgcctcgttactggggggctgtgtggttttggggtgtccgcgcctcattactggggggctgtgtggtgttggggtgtccgcgcctcgttactggggggctgtgtggtgttggggtgtccgcgcctcgttactgggggactgtgtggtgttggggtgtccgcgcctcgttactgggggactgtgtggtgttggggtgtccgtgcctcgttactgcggggaccgtgcagtgtccgggtgtccgcgcctcgttgctgcgggactgtgtggtgttgaggactccttgccacacggggtccatggtaaggggagctcctgctcgtccaggctggaagtccaggatatgtgagtgacagaaatgagcatgcctctccctctcccttggctcctgtcctgggctgcaatgtggaagatgtcagatctgccggagcactggtgtggcatggcatttaggaatgaatacaggggccttcagccagaagacctgccttcaccaccagccacgcagatccctgctggtagtgctgtcgatcggctcacaggcaatatggacactggaaagatggcaggttccttttctgatgatataagtagtatacctcagtagctaagtattttacagcaaggaaaaaaaataccctgtctgaagaccttttaaatatggaaattttttattttctttctctgtaaacagcatttggggagattctcttctcctacatgaaaaacatgctatgttagttccttgactacagactgtgggtgatgagctagttgctgtggaaagctttggagttctctacactcagcgactgcatgctgtgttcttttgcctttgtaaacgtgagtttgacctatggagtgaactttacccagagcctctggggagctgttcaaagctaatgaaccgtggggaaaagaaaccaggtcctgacctgcagggagcagctcccgcaatggaaaccattgtgttccagttccatgactttttgctcatggctatgttgggtttccagtttcacagatggtggatggaaacagaatactggcctgcactgtcatcttcatggtttaccctcccctcagagagacacgtaacgcaaacacacagcaggcagcctgtggggccgttatgggtgatatataaaatgcacgtgggttcagttctcgaacagtcagatacacagcacaggggggttatatgtatgggctctcagctctgtgcaaggcagatatatagcaagtacatgggcccagttctgtgcctggcagatatataacaggcataggtgctcacctctgtgccaggcagatgtataacatgcacagttgctcagtttggtaccatgcggatatataatacgcacgggtgctgagttctataccacacagatatataacattcatggttgctcaagtctgcaccaggcagacacataacatgcatagttgctcagctctgtaccaggcagacatataacaagcacaggtggtcagctctgtaccacacagatatattgcatgcacaggcaggtgctgagttccataccacacagatatgtaacattcatggttgctcaggtctgcaccaggcagacatataacatgcgtgggtgctgagttccataccacacagatatatagtattcatggttgctcaggtctgcaccaggcagacatataacatgcatgggtgctcagctctgtacgaggcagacgtataacacgcacaggtgatcagctctgtaccacccagatatataacatgagcgggtgctgagttctgtaacaggcagacatattccatgcacaggtgcttggtgatatgtcaggtggaatgtgatgtggctgggcaagatccttttgcaactctgagtactgagaatttgcatgtatgatagaacttggcttctagatttaaaaccgtcctcttttatttgcttgcaattaagatataagtatacaataagataggcattttctcccttgttttcttttttttttttccttttcttctctgttcagtttctcaactttcaatttcctcttataccagagggaaataaaactaaattttagccagtgctttgtcccagctgctgagattgcaagtgtcccttcttctcttacttttctcacatgttctcactttatccatagtgtttacctatcacttataatgaagaaaaaccaacatttttatattcatttccttttaggatatgcatttttatacatctgactttaactgataaatgactgtaaagaggtgtatctttatggaattgtagaggatttgtttccaaaaaggagctgatgctgccgttctcagtgacaaagttgatgcgtgtttcatgtctgtctgctcccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacgtaagtgagaccagctgccttcccactccaagcactttcccactgcctgcgagctccctctccaaaaccacttcaccgtgagctgagtgccatccatttaaactaaattgccaagctgaaaatattagacccatggctgtcaattttcaagtatttttttaaagaacaaccagagcttttgttatttatcaattacataataattaaggaagtgtgcttgggcaacttccttgtcaaattataaagccaacatgagccatcgtatctttctgatcattcagattatcctcaggacaagcacatgtctctgtttgtatgaatgtgtgcgtatgggtgtgtgtttgaatgtctttgtgagtaaaactcgttaacggaattttgttgttgactataactttgtaagtgcatttctaggcaacacatttttttgtagaggagggaggaaatggactagctttataaatataataccctacactttacatatttgcccaaaatttattattaataaatttaattttgaaaatatagacagataaaactctttgggaaatcagcaattcctatgaaccatgaaaatatgactgttactgtcaacagccacgctgctgtgtatcttgagtcccacaagttagtttgggtggtaatgccaagaactgcctggaagctacccctgccttctgcggccggctgtgaggtcctgggcaagtggataggcagggcggaactgcttctcagccttggccagtgccacataagagttattaattatgacccacacatcagacagggagccctgggccacagggccctccctgtattgtctctatccacgccgagtgcacccagtgatgagccagtgaccatataacctcttccaatacatctagttattcatcgctgttggcttacaagatgaaaaagtgaaattttaaattgaaaccaaatcttacaaattagaacttcacaaatccgaactctatcattgttgcctagttcagctaaattcaagagctatggtgtaggaatgccagacaagtcatgccctgagaccgggccgcatgtctgcccagcccaggcccatccatctcctctccctccacagagggtggtcagtgccagcttgtgggacgagtggctgagaacaaagccaaaatgttgccctggggaagctcttagacttgttggaaggaaatggggagcaggtgtttgtaagccaggaaataaccaggaaagatgattaccaggaaggggttggggagctggacagagctgggagcagagccaagttgtctgacccatctgctccagcaggaaagtgaaggattggactggatgtcagctctcacccaccttttatttggcacacttaaagacattaggagaattatgaattatctgaaacgtcttctggggaaaagcacacacatgcagaagctatgcttcgtgggtccagggctccaaggccagcctcagtcctggggttttggacccccaggtaaacagccattggttaacttcccactttaaatgtttgtgattcattgcataattctatatgtttgaaagcaaaacatgaaaaaaccaaagccttttttagaccatgggcagggactaagtgttttaagaattacgaacggcgttttcctgttgacgggttccttcttccactcattcaccatcactgccacgggtcccccaggatcattatcacctcattcttcagtggcagagacagtgtctcattcctttcttcacatcagggactggcccagagtcctgtacgaggctccagtactaacaatgttcaaaggacactctcagaactttacactggcaaaactcacaccatcacccaatgtagttgaaactcttcaaaaaaccagcggaaggatgtgagcctgaggccccctgacagcatcacctaaacactggccagacccttccctgcccaagtgggaaaccctctgggagttcactcaccaacagcccttaacacctgaccagaaagcattccatggcctcaaatctgatcagatgtgaggaaaatgggtgagatgtgctgcctacgttactcctgttctaaacacaaatccactctgcccgtggacccccatgccactgtccactcagcaaacacaaatccactctgcccatggcccccatgccactgcccactcagcagacacaaatccgtctctgcctgtggcccccatgccactgtccattcagcagacacaaatccactctgcccgtggcccccatgccactgtccactcagcagacacaaatctgtctctgcctgtggcccccatgccactgtccactcagtagacacaaatccactctgcccatggcccccgtgccactgtccactcagcagacacaaatccgtctttgcctgtggcctccatgccactgtccactcagcagacacaaatccactctgcccgtggcccccatgccactgtccactcagcacacacaaatccactctgcccgtggccccgatgccattgtccactcagcagacacaaatccactctgcccgtggcccccgtgccactgtccactcagcagacacaaatccgtctctgcccgtggcccccatgccactgtccactcagcagacacaaatccactctgcccgtggcccccattccactgtctactcagcagacacaaatccgtctctgcccgtggcccccatgccactgttcactcagcagacacaaatccgtctctgcccgtggcccccatgccactgtccactcagcagacacaaatccgtctctgcccgtggcccccatgccactgcccactcagcagacacaattccgctctgcccgtggcccccatgccactgtccactcagcagacacaaatccgtctctgcccgtggcccccatgccactgtccactcagcagacacaaatccgtctctgcctatggcccccatgccactgtccactcagcagacacaaatccatctctgcctgcggcccccatgccactgcccactcagcagacacaaatccactctgcccgtggcctccatgccactgtccactcagcagacacaaatccatctctgcctgtggcccccatgccactgtccactcagcagacacaaatccactctgcctgcagcccccatgccactgcccactcagcagacacaaatccgtctctgcccgtggcccccatgccactgcccactcaccagacacaaatccactctgcccgtggcccccatgccactgcccactcagcagacacaaatccactctgcctatggcccccatgccattgtccacttagcagagatggtgcaacagttgggtccattcttccatttatccaggatttatcactccattgatgagtccaacaaatgtcaggcattctgccaaactcgatttatacgtgccccaatcattctttttccctaaatctgacgccgtgttgtagataataaagcagagaaagcagccatgtgatgggtctggacagcgacctgcctgccagggacctgctaacttgaaagtcctcgaaactcctctgagtcactctttgggggttaatgtaatgaaagtttctgcaaaaaaaaaatattatgttaccaggaggtatcaacacatttttgctgttgcctattcgcatcttagtttatcttatattccttcacgttttatggattccaacgtaattcatttatttccattttagatgacattgctgaagctcagctttgtaactcagggaagctctcatgatgcctgttttatggacagaaacatgactcagggaaatgaggtgctggaggctgcacaagccaccaaggctctcagctgaaggtagctcagccccaagccccgtggccttcagcccatggcactgctctgtggagggcagggtagatcttcaccctgtggcactgttctgcggagggcaggatagatcttcaccccatggcactgctctgtggagggcaggtagatcttcaccccatggcactgctctgtggagggcagggtagatcttcaccccatggcactgctctgtggagggcagtggcggaggccagggtagatactgtggggagaggagagaaaggaagaaaacggccaggactgggagaattcccatagttgtcactctgtaaccctgtgtttccaggaaacaagggcacgctgagctgtagtgagtgtggacaaaattctcttgaaagattttaacagtggagatgtcagaagcacatcatagggacctcagattaaacaggaaagacaagaccggggaggcacatacacatccatgtgccgtcttcattctgctggcctccagggtcatgttaactgtgctgggaacgacttgggtttcacccacgtgaacgcccagcaccccctatgactgtggctggcaccatgatgtcgtctctgcatcctgttccattacgcacagccctttcataatgttcactcctgggggctctttcaatctaggcacatttaaatatcagcatttttaacgtgtagcaggtgaatattcatatcccaaacatgttctcctaatccaattcctcatttgtcttagttttaaaattgatttctgagttgaccattcccacctaagctttgagaaggctcagttggatttcacatgttcaccacagtgtaggtgcagacgctgtaatgcccaagaggctggctgtggaggcgtctgctgggatggagaggagagaaggatgaagagaggacacatctgctgggatggagggaggggtgaactgtgggggtgtctgatgagatggagaggagagaggggtaaactggagggacatcttctgggatggagaggagaggggtgaactgcgggggtgtctgatgagatggagaggagagagggtgaactgtggggatgtctgatgagatggagaggagagagggtgaactgtggggatgtctgatgagatggagaagagagaggggtgaactggaggggcgtcttctgggatggagaggagagagggtgaactgtgggggtgtctgatgagatggagaggagagaggggtgaactgtggggcgtctgatgagatggagaagagagagcggtgaactggaggggcatcttctgggatggagaggagagaggtgaactgtgggggcatctgatgagatggggaggagagagggtgaactgtggggacatctgatgagatggagaggagaaaggggtgaactgtgggggcatcttctgggatggagaggagagagggtgaactgtgggggcatctgatgagatggagaggggagagggtgaactctgggggtgtctgatgagatggagaagagagaggggtgaactggaggggtgtcttctgggatggagaggagagaggtgaactgtgcgggcatctgatgagatggggaggagagagggtgaactgtgggggcatctgatgagatggagaggagagaggggtgaactgtgggggcatctgatgagatggagaggagagagggtgaattgtggggtgtctgatgagatggagaggagagaggggtgaactgtggggtgtctgatgagatggagaggagaaaggggtgaactggagggttgtcttctgggatggagaggagagaggagtgaactgtggggtgtctgatgagatggagaggggagaggggtgaactggaggggcatcttctgggacggagaggagagagggggtgaactatgggggcatctgatgagatggagagagagaagggtgaactgtgggggcatcttctgggatggagaggagagagggtgaactgtgggggcgtctgatgagatggagaggagagagggtgaactgtgggggcgtcttctgggatggagaggagacggggtgaactatggggcgtctgatgagatggagaggagagagggtaaactgtgggggcgtctgctgggatggagaggagacagggtgaactgtgggggcgtctaatgagatggagaggagagagggtaaactgtgggggcgtctgctgggatggagaggagagagggtgaactgtgggggcgtctgatgagatggagaggagagagggtgaactgtgggggcgtctgatgagacggagaggagagagggtgaactgtggggatgtctgatgagatggagaggagagagggtgaactgtgggggcgtctgatgagatggagaggagagagggtgaactggaggggcatcttctgggatggagaggagagagggtgaactgtgggggtgtctgatgagatggagaggagagagggtgaactgtgggggcatctgatgagatggagaggagagggggtgaactatgggggcatctgctggaatagagaggagagaggtgaactgtgggggcatctgatgagatggagaggagaaaggagtgaactgtgggggcgtcttctgggatggagaggagagagggtgaactgtgggttgtctgatgagatggagaggagagaggggtgaactgtgggggcatctgctggaatagagacgagagaggtgaactgtggggcgtctgatgagatggagaggagagaagggtgaactgtgggggcatcttctgggatggagaggagagagggtgaactgtgggggcgtctgatgagatggagaggagagagggtgaactgtgggggcgtctgctggtatggagaggagagggtgaactgtgggggcgactgatgggatggagaggagagagggtgaactggaggggcatcttctgggatggagaggagagagggtggactgtgggggtgtctgatgagatggagaggagagagggtgaactgtgggggcgtctgatgagatggagaggagagaggggtgaactgtgggggcatctgatgagatggagaggagagaggggtgaactgtgggggcatctgatgagatggagaggagagagggttgaactgtgggggcatctgatgagatggagaggagagatggtgaactggaggggtgtctgatgagatggagatgagagagggtgaagtattgggggcatctgatgagatggagaggagagagggtgaactggaggggcgtcttctgggatggagaggagagagggtggactgtgggggtgtctgatgagatggagaggagagagggtgaactgtgggggcatctgatgagatggagaggagagaggggtgaactgtgggggcatctgatgagatggagaggagagatggtgaactggaggggtaatctgatgagatggagatgagagagggtgaagtgtcaggggcatctgatgagatggagaggagagagggtgaactggaggggcgtcttctgggatggagaggagagagggtggactgtgggggtgtctgatgagatggagaggagagagggtgaactgtgggggcatctgatgagatggaggggagagaggggtgaactgtgggggcgtctgatgagatggaggggagagaggggtgaactgtgggggcgtctgatgagatggagaggagagaaggtgaactgtgggggcatctaatgggattgagaagacagaaagggtgaagagtgtctgagagaaaagtcctttagacccctgactgccatccgtgggtttcacagcttggggagcatattcttgcttaagttatatttagtcatcaataataacagctcgtttattcgggaagtatgcaggaaacatcacgtgctgttctggtgcccaaatgcaggtaaactaacaccagagaatggagctttcagtccagatgctggcaagcaagggcctgccaagggccttttttgtgaataaagttttattggaatgtggcccgctcactggtcatcatgttgctgtgggtacctcccagcttcaggcagggctgagcaggtgtgaggcaccccgacagccggcagaccctagaatacttacatctgggcctttacagaaggtgtgagctgaccccttagaatctaacagacccagtgcacttcagtgagtagtcataagtggcgtaggtaacttacaagtgtaaagtgaggtgctctctaaatgcgtgagacaggactcctaacccattctgggagctccaggcttgtctccctgcagactcacatttgcattgaggggtccaccctagagcattagggtaagcggtgggtaggagagcatcagccctgcacagagcaggaccaagttcccaaagacagcatatttacgggagagggaaataatattttatagtaacactatttcatgttgaatgccaactctgttgaatcactcaggtgcaatcagaaaatggaaacaggttctgcgtcaccagattttagtgtatggggggtaacgtgagacaggagagcaatgaactaggcacagcaccggcaataattgcaggacttgtaatacaccaagaacaacagccatcccagccctcgccgctctggtaactgtgctgaagccaacaccatgacccaagccttagagatgaagaccctgtctcagcgagtcacaccaccggaagtcaactctaggtctctcagttttacgcggctaaaccatgctgccccctgcccccggaggcagcagaatctcccctcggtgatgagtcacctccctcggtgatgagtcctgtgtgtggtcttcccaccagagcctcaataccatcgagcaagcacatttattaaacagttagttgacatttccattttgttatgacccaaatcatgtgttactgcaaataaaagcttccacttaggctgagctaagcacctttactgtgctgagttgataaagttggttgacccacattaaactgccaataatcagccaatatttaaaagcagaaattgtatatggttcaacctgatcattccggacacaagaaaggaaacccacgaacatacgtgtgacaggcatctcactctgcataaatatgtgactcatgagattttgcaagcattgagaaaatacctaatgagtcttgaagatgtttcttcgcctaagaattgtatttggaatccactgttgtgcttcctgctagtgactgagtatcttccacaaacacacacgtgtgcacacactcactacacagggacagagagaggcaagcgagggagaaacgcaatgttaggtcataataacgcacaacaagagactatgaacaatacaaaaaatcatcacagacgacagagtttcttcctctttaggagtgactagtattccacaccgtatctgctgcattttcatccactcaccctttgatgacagaggttgactctgtgacttggcgattgtgagcagtgctgtggcaaacgtgggaaggcagacgtgaatggaagcagagggcattaggttacatgaaataagccaaaatacagaaaaacaaacaccgcaaatccccacctaaatacaggacctaaaacaatggaactcacaggtgcagacagtggaatggaggttacagaagctgggggtgcggaaaatggagagttgagggtcaaaagaaccaccctccgtgagacaggaggatattctttattattattattattattattattattattatttaagttctagggtacatgtgcacaatgtgcaggtttgctacatatgtatacatgtgccatgttggtgtgctgtacccattaactcgtcatttacattagatatatctcctaatgctttccctcccccctccccccaccccataacaggccctagtgtgtgatgttccccttcctgtgtccaagtcttctcattgttcaattcccacctatgagtgagaacatgtggtgtttggttttttgttcttgtgatagtttgctcagaatgatggtttctagcttcatccatgtccctacaaaggacatgaacttgtcctttttatggctgcgtagttttccatggtgtatatgtgccacattttcttaatccagtctatcattgatggacatttgggttggttccaagtctttgctattgtgaatagtgctgtaataaacatacatgtgcatgtgcctttatagcagcatgatttatagtccttccggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgcgatggtgtctcattgtggttttgatttgcatttctctgatggccagtgatgatgagcattttttcatgtgtctgttggctgcataaatgtcttcttttgagaagtgtctgttcatgtccttcgcccacttgttgatggggttgtttatttttttcttgtaaatttatttgagttctttgtagattctggatattagccctttgtcagatgagtagattgcaaaaattttctcccattctgtaggttgcctgttcgctctgatagtagtttcttttgctgttcagaagctctttagtttaattagatcccatttgtcaatttttgcttttgttgccattgcttttggtgttctacacatgaagtccttgcccatgcgtatgtcctgaatgataatgcctaggttttcttctaggatttttatggttttaggtctaacatgtaagtctttaatccatcttgaattaattttagtataaggtgtaaggaagggatccagtttcagctacgtatggctagccagttttcccagcaccatttattaaatagggagtcctttctccatttcttgtttttgtcaggtttgtcaaagataagatggttgtagatgtgtggtattatttctgagggctctgttctgttccattggtctatatctctgttttggtaccagtacaaggtaatttatagattcagtgccatccccatcaagctaccaatgcctttcttcacagaattggaaaaaactactttaaagttcttatggaaacaaaaaagagcccacatcgccaagacaatcctaagccaaaagaacaaagctggaggcatcacactacctgacttcaaactatactacaggctacagtaaccgagacaggaggatattcttcatgtttttagatcagtagcacactgaatactgcaagtaaatgagtactgcacatttcagtatcactgagtgaatttctaatgttctcatcacaaaaaatgtgaaatatttcagctgatagctgtgttaattcacttcatttttctacattgtacttaaaatcacaacacactttttaaccccgtaaatacacatactttgtcaatatacgataaaaattttttaaggggctgggcgcggtggctcatgcctgtaatcccagcactttgggaggccaaggtgggcagatcaactgaggtcaggagttcgagaccagcctggccaacatggcaaaaccccatctttactaaaaattcaaaaattagctggtgtagtggcacatgcctgtaatcccagctactcgagaggctgaggcaggagaatcacttgaacccgggaggcggaggttgcagtgagccaagatcgtgccattgccctccagcctgggccacagaattacactctctctcaaaaaaaaaaaaaaaaaaaaaaatttaaagcaagtaaatgccacaggatatccaacaagaggtttattgtgagaaatggaagaggaaaggcatccctgctggaggctgcagcctggtgtccctgcagcagggacaggtgtcaagagcagcccggggccaggggagtgagaggagcctgcaggacccaggaaggagcagcaacctcggattcccacaggggcacacagcatgctggggaacgggcagcactcagcgtggtcagcactgaccttcctcctcaacctgcccctggccccgcaagtcctgagccccgcccggtgcctccgaggtgccactggcaccagcgcgagtgctcatagctgccagaggcaaggtgtggaaatctgcattaatgtaatctgataacgttttgttggtaaattacgtagacactcttatactaagtttatcttatacccaaagtctgctttaaacaaaattggtgattctataattgtattttaaacagaattgaaagtaattggatacagtgcactgagtgtttttctcttttttgcacaaaagagcttcccagcaggagctgactgacaaaatcttttacgtttccaagtgattcaaatgataaaaatgataatgaatgtttgcttgtctccatgaggcttttattctcctcttggtgtacatgaacaacttctcttcacctgaacaatagttaagaatgcaaatgttatgggaagatcgacttgctaattgtatttaattttaatgtgataggtatgggttcaggttcttaccccggaagttatcgggcacaccaagtccttgggaggctctgggcacctgcgttgactgtgccgtcccgtgagatggaacgtgtcagcagttcttttttgactgcctggtacgggactggaagaaggttgggtctttaattggctgttatcagccctccttctaaaccacagagcagagcactcctgcaaagactgcaggaattctgcttcaaaatgttccacctcttggaacaatgccagaattattctgttaaaaaccatcttatcttcctgctgtaaaactgagaaaaaatcagtcttctcgttaatcacttaatatgcacatcctaattatatatataagcgttttcacttataccctgctatgttctctaacatagtgcaagataatagaaggccttttgctctcaaaaataaaaataaaaacaagcagaaatcctgtcccacctgtctcatgccctggtgtacagaccctcggccttgtgtccccgatcgggaaggtcagattcccagggctgatggccccgtctgtgggtcagaccctgcccacgtgcagagcaccacttagaattattatcaactaattgaaatgcaaattccaagtcctactgaatccaatttactgcatttctaaattagcttatgtattagtgattgagatactggacttgcttatatattaacatttgaaatacttgaataactaattcaattctgattgtgatgaaaggtagaccaaataatttcatttggaggcctttgcttttttttctgcttagttcaattagaaagtcaaagctctaataattttgaatgtctctgggtcattctctaatgaaggtagcactttaaatttataaagaaaaaagagcttatttcaaagatacttcatatcatatgtaaagataaattctgatggattaaatatgtaagcattaaaatcgtatatatacacacacatatatgtgtgtatatatatagacacatatgtatatgagtattctgtactctgggggtggagaagacgtatctgggcatgattccatggggcgtaattataaagataccactttaaattcataaaattaaaaacttatttatgatacaagccaacaagcaaactaaaaataatatcgccaaagtaaaatcataataaaaacctgagagtttttcaatataagtaacaaatgtttatatttttaatatataaagattgccttacaaatcaataaagaaaaaaatgaatgacgcagtgcaaaaatgaataaaggccaagcaaagactattcatctaccttatcaataactaaaacgtttggagagcatgccatttaaaactgaaaatctaaaagtttattctagagaaattcctgagaagcatgcaaagacgtaaaaaatacagccacgttcactattgtgttacatatcgttgcgtgacacggtacattgcctaagtgcccatcgtgggcgttggtttgggtgatgtgggggcactaaggaagcccccaccatgcgctgctaccaccctcagcaaaaggctgctctggaggaggtaaagtgtgtgctgcagcacaggcagccgcagggcagcacgactcagccagctctgcacctgacctgatggcctcaacacctccaccgaaagcctgatggaataagagccccgcccatttcccagcactgataccattcacatccattcccactgttctgtacacgatgaccaagatttcatcaaaatttaggagacaccgtaaaattaaagctcattctcaagacacagggcaatcaatacaagattcagaagtgacatggatgttccttcaaactctcagagaaaacgtgaaagtaactatagttatgcgatcaagcagcggcacagtgggcctggctaaatgggaagcagtggagagaggagaactctaagaaagaggcagagggaaagaccacagatggggttcatggtttcagaaataaaggattttgctggtgagtcatcagcaggctcgacataacgaagaaatcagtgaccttgaagataggttcatggaaattacccagcggaggctcgaagagaaagcgtgggaatcgaaaggcagaaaagagcatccgagagctgcagagagctatcaaatgttctcacacacatagaacctgaatcccagccagaaagacgaaagcagagcagaacagaagaaacgtgggaagcactaatgccagggagtttctaacattagaaagatagatcacatcacagactgaagaacctgagaaaatctcaaagacagatcaacaccagaaacaaaaccccatacacatctacacaccacagtcgaactaccagaagtgaaggatacagacaaacccccacacatctacataccacagtcaaactaccagaagtgaaggatacagacaaaaccccacacatctacacaccacagtaaactaccagaagtgaaggatacagacaaaaccccacacatctacacaccatagtcgaactaccagaagtgaaggatacagacaaaaccccacacatctatacaccacagtaaactaccagaagtgaagtatacagacaaaaccctgcacacatctacacacaccacaaactaccagaagtgaaggatacagacaaaaccccacacatatacacacacaccacagtcaaactaccagaagtgaaggatacagacaaaaccccacacacatctacacaccacagtcaaactaccagaagtgaaggatacagacaaaacaccacacatctacacaccacagtcaaactaccagaagagaaggatacagacaaaaccccacacacatctacacaacacagtcaaactaccagaagtgaaggatacagacaaaaccccgcacatatatgcaccacagtcaaactaccagaagagaaggatacagacaaaaccccacacacatcgacacaacacagtcaaactaccagaagagaaggatacagacaaaactccacacatatacacacaccacagtcaaactaccagaagtgaaggatacagaaaaaaccccacacacatatacacaccacagtcaaactaccagaagtgaaggatacagacaaaactccacacatatatacaccacagtcaaactaccagaagtgaaggatacagacaaaactccacacacatctacacaccacagtcaaactaccagaaagatacagacaaaaccccacacatatacacacaccacagtcaaactaccagaagtgaaggatacagacaaaacaccacacacatctacacaccacagtcaaccagaaagatacagacaaaactccacacatatacacaccgcagtcaaactaccagaagtgaaggatacagataaaaccccacacacatacacacaccacagtcaaactaccacaagtgaacgatacagacaaacccccacacacgtctacacaccacagtcaaactaccagaagtgaaggatacagacaaacccccacacatatatacacaccatagtcaaactaccagaagtgaaggatacagacaaaacaccacacatctacacaccacagtcaaactaccagaagtgaaggatacagacaatccccacacacatgtacacaccacagtcaaactaccagaagtgaaggatacagaaaaaaccccacacacgtctacacaccacagtcaaactaccagaagtgaaggatacagacaaaaccccgcacacatacacaccacagtcaaactaccagaagtgaaggatacagataaaaccccacacatgtacacaccacagtcaaactaccagaagtgaaggatacagacaaacccccacacacatgtacacaccacagtcaaactaccagaagtgaaggatacagacaagccccacacacatgtacacaccacagtcaaactaccagaagtgaaggatacagataaaaccttaaaaaaaaaaaaaaagaaagaaagaaaattatagaccattatgtacagaagaataaagaattacagcacacttttcatcgtaaatgattctggccagaacaccgtaaagtgacatacttaaaacaggaaaagacgttagcccagaattctagaatgagagaaaatatctttcataaatcaaaatgaaaaaagtcatccttaggaaaaaaaaaaaaaagctagggaaattcattgctagcagaccagtactgcaagaaataggaaatgaagttcgttcttttcttttcccccgccaagatggagtctcgctccgtcacccaggctggagtgtggtggcacagtctcagctcactgcaacctctttctcctgggttcaaacgattctcctgcctcagcctcccgagcagctgggattacaagtgtgcaccaccacacccgactaatttttgtattttatatttttagtagagacaagagtttcaccatgttggccagactggtctcaaactcctgacctgaaatggcccaccctcctcggcttcctaagaaaggaagttctttaagcatggctctgaaagaagagggcagcaggaacttagaactgcagtgagagggagggctgcatgtctcggttttggtggtggctgcatgaccgtgcatttgcggaaattcttacagccatgcagaaagtgagacgcactgacccattcagcatctgaaccagagctgcaaaagtgaatcttatgaaacaatggatcgtggaggataaaacagaatcctgtgaagccatttctccaaggtgagaaataaactgtattcttgtacgggaagagaaggggcatacctcagcctcctgacacttccgttttgggatatgtttgtgagtaggctatttaagtcatgagatggctccaagcctcttctccctcccatctgccatgggttgggtgaggtgatcaagtgagtaaccaagagaacaccagctattgatggacgcatctgagaagagctcagaagacgggctcagatattcctctggcccatgagcctgccctgggatcaccttttgctccacacagcgtaacaccaccatgctgggcaagctgggtacctggcctggggatctcctagcatccactggcctgtggcgggtggctgtgcctccgtaggcagggagcgtcggggctgcttttgagaccttgcagagtcaggctgacatctgattaagaagcctttcaaagaaatcacagtttttgcagaatccatctagaaagatgaaagacccttcagagccacttcctgtgtttctaagcccagcagtcctgacgtttttgcctttcctgatgctgagactccatttggtatctgggctctcacagcttccttcagatcactcagctcctagcacctctcggccaccagctccaagtcctgcctctcacatcaaaggctgatctcacgtctcagctttctgtttgagaccctccacgcgctggttgcaggggtttgcctgatcccagtgcagatccttcgtgatctgcccccggaaagccttgttcccctgacaattttcttcctcctcgctcctctgacttgaagtcggctgttcaccgtctcctccttgctgccggtcatccttccatgcccagctctgattgcctcctctgggaaggctccctggagttacgtcccctgcagcatatttcctcactgctcgtgcttgtctctaccacatgcctgtttgctttcccgagagtccctatagcctttgaaagcaagagctgtctcatttatcattgccattgcgccttcactgtgaggcattatatgtgctcctcacacactggatgaatggataaaaccatcgtcttatgactcatttgtcagggattattgataatcaacttaataaatgaactgctattagcgacgccgataaagtaatcctgtttagagcctaaacataaagataatcaatttaaaagacgtgtgcaaagctgattcacattcacctgatttcttaagctcctttaggttctattagtcaaaacgggagcagacgccagactcctcgtgcatgccacacacctgcaacctgcagttcttcagttaataggaagccatatgctcctggggaggaggcatcctctctcacagtctcctccactaccgtgggctgctggctcttcatttttagtttcagctggagggaagcggaggggagattctggtccagcctgtgttgcaaccgttgccagcacgtgcagagagagcatttgcactctgatcggtccagccctaggggttcccaggtccctgacgatgtctctcctcagaagctcaggcatctgggcatgaggtgaggacctggggattcgaatggcacttggcacttgctcctgggggtctctgcccatcagggaagcagctcaccccacacccggcggacccaacaggcagccatgaagaagggcaccagaacattatccatccacctgtttcgtgctgtttccagtatcttaccttacatctcttcatggatttcattgtttctctagtaaattcttcactttttacctcatttctttcttcttgtgcataccaactctagtcttattctaacttttttctattagaaaaaatgtccttaacgttaaatcaaaaacttaagtacaatgaaagacaaattaaaaacttccatttttaaattttgtgctttacttattcttttctgttatttctatgtttctcatattttacttcaacatctagtttttggcctgctacaactgatattgttttcatgaagaccttagttaagagggaggctcctaagactggcgcctggtttgttcattaatactcctggctgtgaatgagggctcacacctgtgatcccagcactttgggaggcggaggcgggcagatcacttgagatcaggagtttgagaccagcctggccaagatggcaaaaccctgtctgtactaaaaatacaaaaaattagccaggcattttggcccgtgcctgtaatcccaggtacccaggtggccgagccaggagaattgcgtgaatctgggaggcggaggttgcagtgagctgagattgcaccactgcactccagcctgggcaaaagaccgaaaaagaaaaaaaaatactccttagggctgtcagttcagggggctgtagtgagtgctgtcttttaccatccagcacttttatggcgaactgcaactgaaaaacacataatccacagaccacgtaagcttttctttttttaacccaactgtgccattgcaggtgcaaacaagaaatgcagcttagcgagctcaccacagggagacatccctagagatgcgtctctggaaaacctggcggccccgtgcccccaccacccagccgtgggcagtgcctgggcagtactgtagccagcctctccatacactcgcagtccattcattaaatcagttattaaactgatgcttaaactgtaaaattatgactcattgtaaagagctaacacacgtaattgtgtgaagtggagtgtcactctgtctctggcatgtccatcgccaggggtttccactgcccatgactttatcctgtccggacactttcgtgtgtgtataaaaatatacacatatgggcgtagtttacaataaacatgaggtcccactgcacgcattactgtacaatttccttttttctcccaaatattttgttagttttccgttgctgtcataaaaactgccacaaacttagtgtcttaaaacagggcgtttatcctcagccaagtcctgcaggtcatgagccaacacgggtttctctgggctaaggccgaggtgtcggcagcctgccctccttccgggtctctctgggctaaggctgaggtgtcggccgttggcccttctttccggggatctgcgtggggagtggttttctttcacatcaagatgttacagttgcgggaccgaagccccgtgtccttgttgtcagctgaagtcagccccctgtttccagaggccacccacagggatgtgttagctctggcccctgcctgcatcttcagagccagctggacggggtgtggggtctctctcactctgcagacccctcctgtctcacgtccacatcgatctccgacttgctctgccttcctcttctgctttcaatgctcctgcgctgagagggggcctgcctgggtcatcaggagattctcactaccccggggtctgctggttagcaacctcgattccacctgcaaccttcatgcccgcttgatgtgtagcgtaacgtgttcacagatgtggcaccagcgtggaaggccctaggggtcagagtcccgcctgcagaggtaccacgtgcgtccttctgtggcggactctaggcccagatgtcactggacggacacactgctgcgtgactttaacattaccgttggggaactgcctctatgtttttattactgcacagagtgttgtaaagaaaatatttgcgaatgctcaaccaccagtctacttattgccaaggtatctcttcttctgggtagcatcataaggggattttctgggcatgtggctccctctgaagcttttatgctttcaccttcatcagtgcagctaaggagattctgactagaatggaggtcttccaaattgcttttttctaatgggctgattatacccataatctatgcatagtttaacccctgcctctggaaagtcctagcgggaggggcaaggatcccacagacactggcttattgcctgtttccctaaaaacattacaggatgctttcttaaaaacatcctacttccaaagggcagtttgagaatctcctaattttaggcagcaaagccttatcccaaatactggtctctttgcagaaatccattgcccgttcatctataggaactatttaatttcaggaaataactttcttaggagatttttatagatttgcttctcaggaaaaataactttgcctatagtggtctgccagcttcagggggatggtcttgaaaaaggaaaatggtgatctggggtgaggccagagaggaactggctcttgggtggatttatacattttcagttgttttctaattcattaacttctgcttttattgctatttcttcttttgttttcttagacctatttgttgtttcattctttatctgaaagtatatttactaataaaagtatataaggctatgaatgtttctaagaatatatcttagctacatcacacatatattgatagatgatgcttttatagtcactgttatctaaatactcagcaattttgactttgatttccactttgactcaaggggtgaatgaatgaaatgaaggagagatagggttactattaaaaatatagctactattaattatttttctttctttaaattactttttcaaatttttataatgtgtaaaattatttaatagtggccattttctcttttcaggccctgcttttggtagggagttcggttgagagacataaataaaataccatgatttttttccatttctaattatatgaagtcttaactttccaaaacagttaagtcattcatgataacactcagagccacaaaatgcatttactagctcttcactataccaatgagctacttttctgagttttcctgtaactgtgacacgtgcattcctgccccataaccaagggccttacctgagttcatcacgtgactcctaatagagttctggtagcacaatagaaaaataatttttcacattcgcacgatgaagagtgttcagaacaaccattccttaaatatgagtcactctctttactgtcatagccttcagaatgtctaacagcagcagcacggatagttcagctaaatacttctgtatttttagctgaaaaaattcatgcaaggctttctgttcatgtctcttaatctaatggctattgaaggtgcgaccttcgagattccagagaatgtactgaatgaagagaacagagcaaaaaagagtccaatctgtaagatctgaggacacagttaagtggaatcacaccattagtagaacccggtgctaaccttgaagcagcagcgagttttactaaacagctcatcttatatgtaattctccccaatagtaaagacaatgtgttctatgagttcattgtcttctttggcgtatgatgcctaatttatgaattttttcatttattcattcggtaagtaaatatgtattaaggactgaatagataaataaaataattgtcaagtaaataatatgtgtacagactgttaaaacattaacagtgtttaacagggtgctgtggctcaggcctgtaatcccacaactttgggaggctgaggcaggtggatcacttgaggtcagcagttcaagaccagtctggccaacatggtgaaagctgtctttactaaaaaaaaaaaaaaaaaaaaaaaaggaaaaaaaattagctgagcatggtagtacatgcctgtaatcccagctactcagaaggctggagcaggagaatcccttgaccccgggaggtggaggttgcattgagccgagatcacgccactgcactccaacctgggcgacagagtgtgacttcatctcaagtttggagggaaatctgccttactcaaaatctgccaatgtgagcattaatctcttgtaaaacacaccttcacattcaggtatttgagcaaatgccatggtaccatatcctagttgacacacacaaactatcacacacagcaatgaaaactaataatgtatgaatgcacagtaatcccaatggtggttatctctgggtttgtggttgaattgtattttcttttaaatattttccaaattttctgcaaaaagcatgtagcactaaaataagaaaagataactgaaaaacattagtttcgttgtcttctaggccccctagcaacctataagtacagtttttccaatagtaacactgcatttaaaaacaaattatccttgtattgcagttaccatagtaataaatttgtcatcaacagctttattttacttttcagctatgagtggaacaataattctgtgtgtttcaaagcctcagaaatgaaacttattccttgcatgttgccacattttgtgtctccaaggtaattttttttgaggtagggtcttgctgtgttgcccaggctggagtgcagtgggaggatcacagctccctgcagcctcaacctccccaggctctaatcctctcaccgcagcctccccagtatctgggactacaggcttgcgccaccatgcccagctaatttttgtttttgtttttgttattgtttgtagagatggggtttcatcacgtagcccaggctggtctcaaactcctgggctcaagcaatccacccgcccaaggctgtttttaaagaagatgtacagtaagggaatacgtagagacagaaccacattacagggagtggttggggtttgctgttagcaccggggaatcccttgccttgatggagggtgaggaatgcgcatttgagtattgctagaagctttctgaggtcacttctgaccccgcaacaccatttacatttgggggatggactgtactagtttctggggctgccataacaaagtaccacacacagcgtggcttaaaacaatagaaatttaccctctccagttctgggagccagaagtctgaaatcaaggtgtgggcaaggcctcgctccctgcacgtctctaggggaggatccctccttccgcctcagtgtccgtggctgtgggtgcatcactccaccctcggcctctgcctcccaggaccttccccatcttcgtcccttctcctcttctcataagagcactgtcatcctcggagcccactccggtgacctcatctcaactcatttcgtctgcagtgaccctatttccaagcgaggtcatgttctgaggcactgggggtgaggatctccatggacctcttctacagggagacacagttcaggccgtaccagaagcaatcgcgtcgccaggataatgaagtatgcataaaatggcacccctctatcttggtaattatcagacactgtttctgaaacttatttccatctccgtgttggcttttctcttccggaatgtatggtcaaatataggatgtcatttctccagctgggtgaccatggtgattttgctgctgactactggaagggaagcacggattactcagctgaaacctgatttcctttcctcagttatctgtcttcaaatcagtttagcgattgttggtgattcttcatgaagagcagtaactttagctggctaaaataaagagaaatgtgtactccacactctcaaattccactttaatttcatgattaactgagtttgtagttctaagaaattggttgctcaaaatcttgttctgtcctattcacttgaaaatgggaatcccacctctgtgctcctgggtcctgagggacattccttcctccccatcccgttcggaggctccctctggtccagagcagacagccccttgcatccctgagccccacccctggcagaggccttcactgtcaatgtcattaccagggactggtggatctctatcccttaaccattctttaagccaccttaaagaagccatcttcaatggtgttggaggaccaagcaaaacatatgtgcttctagtcttgggataattaaggaagctcaaaacatgaggatgtagatatgaaaacatcttacacattcttgcccttccgtgctcgggacccaaccccatgccggcagctgcagaactgggtgcactcaatctcaggtgcagcccatgaagacaccagcccttagccctgtccagacagacctgatgtcttttaaccttcagtctgttttcctattcaaagttctgttcttcccttccctctgcaaagcccaaacattaatttctagggaattacagggaagggaggttagagcatgggggtcactcacaccccctccccctccctcttcctaacgctggctccatgtgggccaggtgggaaggaggatggaggagaaagaaggctcttgactgagcaaaaagaaagggccctcctggtctctggtcactgcttctctaagactggacgttggactgggcatttttcaattcttttgagtttcctgatggggtcttcccctcctttcttttctaacatggagagatggctcagcctcccctttcctgcctaaccccctcctcccactccacctccactgttcacccctgcagcctatttgtggggtacgtttctttgggactcactgtgggtaaaatgacccacacccgatacttgtcacacatctacttgacctgcaggaaatatgcgtgtgattgctctacccaaaggcatgtgtgcagccagtttacaccccacacacccgcatatctcctggccccacatcacacccaactgcatcctggatctccagcgggaggccctcacccatccccagcagagggaaaccctgctgcccttcacgtttgtggattctgaagccctcgcttggcctctgcgtcaataattctgacatgaactacaaactcccacggactcccagggaggttcctcccacccggggcggtggatggaggaggagcggagggaggaggtggcatgcagacaggccttggaaatccgagcacattttccaggatctagcttcatgcctcctgccacacgattctgctgggagctggggcagtgagtatccagtctcatttatcccttatccaccatggcccttgttgggcccagacacacaaacagctgcgatgggtgcagagcaaggtgccccagcacacgcccgcccaggcttacctaacggggccatctcctggccgcagctctccatggttccccactgccagtttagtccagttcacatttaccaagatccttcacaaaatacgcccccatcggctgtttcttattagtctaaggttgattatgttcgattatgttcagtaaaaatctttaattatgaaaactctgaaaatcttcacatactattttttatccctttctaacatctttatattgacgattggcctgacgtgtgcctctggcccccttgactttacccctgtgtttctgcttggaaagggctccctgaagtgcaaatatggtcctgttgcacatttgccccctgaagctctggaaagcggtccccaaatcccatccggatgtaactggaaggaaattccaacatcctcctagtccagccgagggggttcccaccacggatttccttttcagggctcccattgcattactggacaacttctaactattgaaaattttccattgggagaattctccgtgtgtcatttttctgtagttccatttaatgcagtgatagttattttttatcttctgtgttttctctacttcctgattaaattatgacctcctcaaatggaagggcaatataaactcatttctttttattatcccacagtaattgtcaggctcagacttctctgtgagcatcaccgactgaccagggtaccgctggctgggatgttacatggagcagttacactagcattttagtttcaaatggatgcagattcagcaaacactttgattatctaaaatcacagcaggatgatagattttactgtctactgatccttacatttatattatgaagtactcaaattatttattaattcagcatttgtgattatacattgcaatagtaaaaatcttttggggagtgatttcaacaagataatggagtaggaaggtctgggccctccttcccctcaacaaacacagccgttcaacaatgatttgtggacaaattccctttacaaaaatttagacactaggcctggcgtggtggctcactcctgtaatcccagcactttaggagaccaaggcgggtggatcatgaggtcaggagattgagaccatcctgggtaacacggtgcaaccccgtctctactaaaaatacaaaacaattagctgggcgtggtggcgggcgcctgtagtcccagctactcaggaggctgaggcaggagaatcacgtgaacccaggaggcggagcttgcagtgagccgagatcgcgccactgcactccagcctgggcgacaaggcaagactccgtctcaaaaataataataataataaaataaaaataaataaataaataaatgacactaattgaaaatctcctgcaccttgggaaaatacaaaaccagacttaccaaagatgctcgggagattctctcaagaattcctaccctggcacagcaccctacaatcaggaagagaccccctggcttctaccttctcccaggggagggaaggatcagttagcacatccagcaccccaacttttccaagagagctcccagagtctggcctctgacctgcaagcattgggcctgctggagtctggcccactctggttgcctgggggagaatgaagacagtggcatggctggtagatgccgtagatcctctccctcctcagcacagaataagcaaacaagaactccatctctcagcttcccactgaagaggaaagaggtgatccatgcatcccacacctcagcttcttcagggttgcacagagaactggcatctaccttccaagccttccagtcttggagctctgttgggtccagcagtccagccacataggggaggacagagatgacagcttagactagtagatgcgatggtgttcttccctgattcaggcagagcaaacaggcgaaaaccacagctaccttcttctctctgggaagggaaagaattggctgagaccctcagaatctctgaatgattggtgggggtcttctcatgtataagacaaggtcatgaagactgagaaaggcaccagtgcggaaagtcaaggaaaatgaaaactcaggcaaagatatttcaaagaaataaaacaaatctccagaaactgaccctagtgaaatgaagttatatgatttattcgacagagaattcaaaacaagggatatgaagatgccccctaaggtcaagagaacaatgaaggaacaaaatgagaatttaagtaaagtgacaggacatattttttaaatatgtgccaaacagaaattatggagctgaagaacataattgacctgaaaattttactggaaagattcaacaacagaccagatcaaacagaagaaagcatcggtgaactcaaagacaacatcgttacaaataattcaatcaggacagcaaaaaatagcaataaaaagagtgaagaaagcttacagaacttacgggaaatcaccaaacagatggggtttcaccatgttggccaggctgatcctgaactcctgacctcaagtgatctgcccacctcggcctcccaaagtgctgggattacagttgtgagccaccgcgcccggccaggtcacactctcttataatgactaatagaactagagtttaactgccaaaaatatagtttttttaaaaaaaagttaaacattttaaaagtcgaacactcattcctgcccctgatctttctctgtgctctacctcctgccagccatgccccctgggcacagccaattctgtcccacctctgacttcttcctgccactcactggggtctccagctgtcagcaggaccatcgtggggtcactccactaactggcctcccgcttcccatcttgaatccatacacactgtcctccacacaacagctcctggggtttctttttttttctttttttcttttttgagacaagatcttgctctgtcacccaggctggagtgcagggcgtcatctcagcccactgcagcctcaacctcccgggtgcaagcgattctcccacctcaacctcccgagtggctggtattacaggcacctgccatcacacctggctaatttttgtatttttaggagagacagggttttgccatgtttcccaggttttacgggctttttttaaatatatataaactttttattgacaaataacataaataacatacaaaagagaagaaacaataggttcccacctcaaaaatcctcccaaatactgaagtcaagaaataggtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaagaaataggtcattccggaagcccccagcgagctccccacccagttactcccttcttcccaaattcaccactaccctgcctattattattttttaactataaatatttatttagtagtctgaactaagtgctaaatgaaattgaaatgtattttattctttttttaatagtaatttttttttaattttattattattatactttaagttttagggtacatgtgcacaacgggcaggtttgttacatatgtatacatgtgccatgttggtgtgctgtacccattaactcgtcatttagcattaggtgtaacccctaatgctatccctcccctagctccccaccccccaacaggcccctgtgtgtgatattcccttccctgtgtccatgggttctcatcgttcatctcccacttatgagtggcaacatgcagtatttggttttctgttcctgtgttagtttgctgagaatgatggtttccagcttcatccatgtccctgcaaagaacatgaactcatccttttttatggctgcatagtattccatggtgtatatgtgccacattttctttatgcagtttatcattgatggtcatttgggttggttccaagtctttgctattgtgaatagtgctgcaataaacatacatgtgcatgtgtctttatagtagaatgatttgtaatcctttgggtatatacccagtaatgggattgctgggtcaaattgtatttccagttctagatccttgaggaatcaccacacggtcttccagaatggttgaactaacttatactcccaccaacagtgtaaaagcgttcctatttttccttatcatctccaacatctgttgtttcctggctttttaatgatcgtcattctaactggcatcagatggtatctcattatggttttgatttgcagttctctaatgaccagtgatgatgagctttttttcatatgtttgttggcctcataaatgtcttcttctgagaaatgcctgttcatatcgttcacccactttatgattgggttgttaggtttttttttcttgtaaatttgttaaagttccttgtagattctggatattagccctttgtcagatagatagattacaaacattttctcccattctgtaggttgcctgatagtttcatttgctgtgcagaagttatttactttcattagatcccatttgtcaattctggcttttgttgccattgctcttggtgttttagtcatgaagtctttaccagtgcctgtgtcctgaatggtattgcctaggttttcttctaggctttttatggttttaggtcttatgtttaagtcttttatccatcttgagttaattttagtataaggtgtaaggaaggagtccagtttcagttttctgcatatagctagccagttttcccaacagcatttattaaatatggaatcctttccccattgtttgtttttgtcaggtttgtcaaagatcagatggtcgtagatgtgtggtgttatttctgatgcctctgttctgttccattggcctatgtatctgttttgatactagtaccatcctgtttggttactgtggccttgtagtatagtttgaagtcagctggtgttctttgtcagctttgttctttttgcttaggattgtcttggctatatggactcttttttgattccatatgaaatttaaagtagttttttttttcctaattctgtgaagaaagtcaatgggagcttgatggggatagcatggaatctgtaaattactttgggcagtatggccattttcacaatattggttcttcctatccatgatcatggaatgtttttccatttatttgtgtcttctcttatttccttgagtggtggtttgtagttctccttgaagaggtccttcacatcccttgtaagttggattcctaggtattttattctctttgtagcaattgtgaatgagagttcactcatgatttggctctctgtttgtctgttattggtgtacaggaatgcttgtgatttttgcacattgattttgtatcccgagactttgctaaagttgcttatcggcttaaggagatttagggctgagacaatggggttttctacatatacaatcatgtcatctgcaaacagagagaatttgactttctcttttcctatttgaataccttttatttctttctcttgtctgattgtcctgaccagaacatccatcactatgttgaataggaatggtgagacagggcatccctgtcttgtgccagttttcaaagggaatgcttccagtttttgcccattcagtatgatattggctgtgggtttgtcataaatagctcttattgagatacttcacatcaatacctagtttattgagagcttttagcatgaagcagtgtcgaattttattgcaggccttctctacatctgttgagataatcatgtggtttttgtcattggttctgtttatgtgatagattatgtttactgatttgcatatgttgaaccagccttgcatcccagggatgaagccgacttgatcgtggtggataaactttttgatgtgctgctgtattcagtttgccagtattttattgaggatttctgcatccatgttcatcagggatataggcctgaagttttctgtttttgttgtgtctctgccaggttgtggtatcaggatgatgctggcctcataaaatgagttagagaggagtccgtctttttctattgtttggaataatttcagaaggaatggtaccagctcctctttgtacctctggtagaatttggctgtgaatccatctgatcctgggcttttttttgttggtaggctattaattactgcctcaatttcagaacttgttattggtgtattcagggatttgacttattcctcatttagtcttgggagggtgtatgtttccaggaatgtatcagtttcttctagattttctagtttatttgtgtagaggtgtttatagtgttctctgattgtagtttgtatttctgtgggatcagtggtgatctcccctttatcattttttattgtgtctatttgattgttctctgttttcttctttaatagtctgggtagtggtctatctattttgttaatcttttcaaaaaaccagcttctagattcattgattttttttgaagggtttttcatgtctctatctccttcagttcttctctaatctgagttatttcttgtcttatcttagcttttgaatttgtttgctcttgcttctctggtccttttaattgtgattttagggtgttgattttagatctttcccactttctcctgtgggcatttggtgctataaattttgctctaaacactgctttagctgtgtcccagagattctggtatgttgtgtctttgttattgttggttccaaagaacttatttatttttcccttaatttcgttatttacccagtagtcattcaggagcaagttgttcagtttccatgtagttgtgcagttttgagtgagattcttaatcctgagttctaatttgattgcactgtggtcggagagactgttatgatttccatccttttgcatttgctgaggagtgttttactcccaattatgtggtcagttttggaataagtgtgatatggtgctgagaagaatgtatattctgttgatttagggtggagagttatgtagatgtcaattgggtctgcttggtccagagctgaattgaagtcctgaatatcattgttaattttctgtctcattgatctaatattgacagtgaggtgtgaaagtctcccattattattgtatgggagtctaagtctctttgtaggtctctaagaacttgatttatgaatctgggtcctcctgtattgggtgctcctgtattgagtgcatatatatttaggatagttagctcttcttgttgcgttgatccctttacgattatgtgatgctcttctttgtctttttagatcgttgttgacttaaaatttgtcttatcagagactaggattgcaactcctgctttttttgctttccgtttgcttggtaaatattcctccatccctttattttgagcctatgtgtgtctttgtacatgagatgggtctcctgaatacagcatactaatgggccttgactgtatccaatttgccagtttgtgtcttttaactgggacatttagcctgtttacatttaacattaatattgttatatatgaatttgatcctgtcattatgatgctagccggttattttgcccattaattgatgcaatttcttcatagtgtcgatggtctttacaatttggtatgtttttgcagtggctggtaccggtttttgctttccatgtttagtggttccttcaggagctcttgtaaggcaggcctggtggtgataatatctcccagcatttgcttgtgtgtaaaggattttatttctccttcacttatgaagcttagtttggctggatatgaaaatctgggttgaaaattcttttttttaagaatgttgaatattggcacccaccctcttctagcttttagcgtgtctgcagagatatccactgttagtctaatgggcttccctttgtgggtaacctgacctttctctctggctgcccttatcattttttccttcatttcaaccttggtgaatccgacgattatgtgtcttggggttgctcttctcaaggagtaactttgtggtgttctctgtatttcctgaatttgattgttggcctttcttgctaggttggagaagttctcctggattatatcctgaagagtgttttccagcttggttccattctccccgtcactttcaggtacattaatctaatgtaggattggtcttttcacattgtcccatatttcttggaggctttgtttgttcctttttgttcttttttctccaatcttgtcttcacactttattttaataaggtgatgcttcaatttctgatatcctttcttcatttgattgattcagctattgatacttgtgtatgcttcacgaagttctcatgctgcgtttttcagctccatcaggtaatttatgttcttctctaaactggttattctagttagcaattcctgtaaccttttttcaaggttcttagcttccttgtgttgggttagaacatactcctttagcttggaggagtttattacccactttctgaaacctacttctataatttgccaaactcattctctgtccggttctgttcccttgctggtgaggagttgtgatcgtttggaggagaagaggctttctggtttttggaattttcaaccttgttgtgctggtttttcctcatcttcatggatttatctatctttgttctttgatgctggtgactttcggatagggttttggtgtagacgtcctttttattgatgttgatgctattactttctgtttgatagttttctttctaaccatcaggcccctcttctcaggtctgctggagtttgctagaggtccactccagaccctgtttgcctgggtatcaccagtggaggttgccgaacagcaaagattgctgcctgttccttcctctggaagcttcgtcccagagggactcctgccagatgccagccggagctctcctgtgtgatgtgtctgttgatccctgctgggagatgtctccccatcaggagacaagagggtcaggggcccacttgaggaggcactctgtgccttagcagagctcgagcgctgtgctgggagagctgctgctctcttcagagccgagaggcagaaacgtttacgtctgctgaagctgcacccacagccgccccttcccccgggtgctctgtcccagagagatgggagttttatctataagccctgactggggctgctgcctttctttcagagatgccctgcccagagagcagttttacaggctttttacagacagatcagaccgagtccctgaaaactccgtgacagatgtttgtcacattgaaagtaaaatggagcctctccgcctcggcccacaaacgtctccattatgagaccaagcctggtctgctcgttcaccactctggtctttaatttcctcaaatgctcagagctctctcgtagcttagggtctttggagttgctgtttcctctccctaaatggttcctctcaatccttgcataattagtcattgagatatcagcttaaatagcacctgttcagtgagacatttttttcaccaggcaatctgaggtagctatgtagtcacttttgatcctaaaaccttaatttaacagggtgtgtgtgtgtgtgtgtgtgtgtgtgtgtgtgtgatcagcccgtgctaccttcttgcttgtgggggcctctatccctcacgagctgtcagtcctgctgcctgctgcatcccagacttgggccatgcaagctgcattgaagcactcagcccacacttgtcaaatatgtgaatgagagagtgagtgaatgtatatgttcttaatgcccagcatcattcacaacacatattcgatattaatgtttgttgaatggcccaatatgacaagaggagtaaaagtgtttctagtaaacagtgtaagataatgttgttatttctaattaatgacattctagtagaaagtgtaagacagtgttgctgtttctaattaatggtgtgctctgatgaatcgatgtcactgaaatggggtctttctttaaaaatgcagacatgctttacagcctggctgcttcaaagttgggcattattaagaatctccagctttaacagtgaaaggcctattccacacagggaatatactgattcatgcagccatgttgcccagagctagccagggctggaggcccgaatccacggaggccgggccaggccaccccagcatcaggcctcaggcctgcccacctgcactggcttcattcagaccgtcccaggcaatgatgagatggcaccagctactccaggctgaccctctaccagctcagagaccaccaaggcagcaaggaagcccctccttcccaggagtgacagcagtttattcattcattcatttattcatcccacaagtgtctcttgagctcctccatgtgtcaggcactgctccagatgctccccaatgtcgtgggcatggcaggcagtgacagctctcatgcttcccatgctgtcacagaggaggacagataataagcagtaaacatgacaggtgatcagtaataaaaagtgaagtgtgtagcaccctaaaggtgtcgagtgccgcgagggaaaattcaacagaatgagggggtctgtaagggtggaaggctggctctcagttctgcagaggctggatagagtggaggctgggtctcagttctgcagaggctggttagagcggaggctgggtctgagttctgcagagcttggttagggtggaagctgggtctcagttctgcagaggctggttagagtggaggctgggtctcagttctccacaggctggttagagtggaggctgggtctcagttctacagaggctggttagagtggaggctgggtctcagttctgcagagctggttagagtggaggctgggtctcagttctacagaggctggttagagtggaggctgggtctcagttctgtagaggctggttagagtggaggatgggtctcagttctacagaggctggttagagtggaggctgggtctcagttccatagaggctggttagaatggaggctgggtctcagttctgtagaggctggttagagtggaggctgggtctcagttctacagaggctggttagagtggaggctgggtctcagttctgtagaggctggttagagtggaggatgggtctcagttccatagaggctggttagagtggagtctgggtctcagttctgcagagcttggttagggtggaaggtgggtctcagttctgcagaggctggttagagtggaggctgggtctcagttctgtagaggctggttagagtggaggctgggtcttcattcttttgggttgtgccagcaaggccatgacatctcctccacactgtgatgggctcagcatccagctcatagtagttggaacagtcagtatttctgtctcagggattatttatctaagggactggggctgaggagggatctgcaggcttctaaacctgaccacatcatcctccccatgcgtcctgctggcaggagaccaccgttcaatatttgaccacttaatatttggtgagattccatgcaaattactaaactcaagttgcctccgtatgaggagttttctgagtcctgcagctccaacccccacctccccacataccccagccaccgcgtcggcacctctcctcaagtcaagccagctgcggccacacatttccattctgatgcccaagacacagctgggacagaacacattcttaaagacacttaagtgaacaggcacaaagatgaatgacccttcttcattttgtggacactgcagacactgttcacatatggccgttatcgacatggattcagaaatcattttcctggaaacattgctaggtaactgcgggagaagggaccttgctataaatgcactggagtttgctgaaaatgtaaatacgaattttatctcctaacaccagggagagatgtttcactagggtgttcattatgatttgcaaatgaaatggacaaaattcagattctctaaacagtacctcagtggggcatcctatccctccatccaaatagatccatgtttctcaaagtgtggtctggcccatagaccaccaggaatggaatcacctagaatgtttatttaaaatttggatttggggctgacctcacccttctaaattccatctccggggatgcgatccaggaatcaacattacatgcaagcactcaggagatcgtgatacaggaatctatattacatgcaagcacacaggagaccgtgatcctggaatctatattacatactagcatgcggaagaccgtgatccaggaatctacattacatgcaagcacgcaggagactgtgatccagattgggatttgcaaaaccatccaatgaatgtcttcttgttgctccgacaccagcctttaaatgtaaagtgacaacagtcaaaaatatttataaagaaaaaagcaatgtacttgttaaaaaaaaaactcaaacataaatggcttagatgtaaataataatgaagataccacaggcagaatcatagcttctctgtgataggccagccgttagaatcgctgagcttagcatctaccaggagctgctgcagaaaaggtctgatgtcttgtgtcgtgtgtggagtacttgtggtgtaacaggataaagatagtgcagtcgctttgttgttagaagcaacagcaccagaagccaggcggggcacaccaccctgcagccaacctcggtgccatcggctcacctgacctcatcggcccctgaggatgcaggccaggcaccatcattgcttccactgccgaaagaggaaacagtgggtgagcaacatccgtgacttacccaggttcatacggtgaggatgcacagaaccgaatgcaagccccagatccggacctcctgacctccactcctgtgttctggacacagctccctactactcaggggagtggaccaatttgagccgaagatggttacctacttgattcgcacttccgtcgccacacaagtgatacagcagggctctcagagtgcgtgcctctgagatgcttgagaagcaaagtggtctccatattcccctgacgtcttctgttcgtgacttgaaggaagcagatgatcacaagagtctctggtgaatgcgtgaatccagggctctagtgagtgcggcctgtcctttgtgcatgagctttagaaacgtgctacattcttgtgggcctaagtgcctctttaggatgaaatcttttcaattagcaatcaaagacttttataccctgcccctttccatggttgtcccctccagcaaatctgtgatcccgctgatgttaccttccctgttataaggaagaaaacagagaatgcagcgtttgctaactgtccgagcccacagcgtccatgatggggtgagaaccgaagccagcagctccccactctggaagtaaactgttgactcatttccgtgtttgtctgaattattagtttatcatatagttgtaataatccatggcaaatgtttaaaatatgccacaaaagcaacacatgccaaatttggaatcagaaggtcttcaggctcaaatctcagctcgagctcgtgctgtagaacgtgtcacctctgagtgaagactttctcttcttgttaaagcaaggttaattataataccttccgcagagaatcataaccagcaccaaatcagaggcgaagaatgaaagtatttgtggaaaatgaattatcgttaactctgctgccccagagctccctcactgtccttccttgaggcccaagagaaaagacgaactgaaggtaccagtgggttttttttgaaaatttgcttcaagtctacattctgaacgtacggttcatttcaactttcagatgacataaagctaaatagagtgctcttcgtatcttattttcctcctttattgagttatgatttaagaaccatacaattcatccacttgaagtacaattcagtggttcttagtttatttatggacttgcgcgaacatcagtgcaatccattttagaacataaactttacaccaaaaagaaaccctgtaccgtcactccccacttcccctaactcctccaacccctggcaaccacgaacctgcattctccctgtcgtggccatggaaccccacaatactgtatctttgtgtctggcttctagcataacgttttcaacattgatccacattgcagcatgtgtcagaactgcaattctttttatgatggaagcatattccattgtatggatagaccacagtttatttacccatccatcatggatgtatacttaggttgtttccttttggaggctattatgaataattctgctatgaccattattctgtttgttttctgagatgaggtctcactctgttgcccaggctggagtgcagtggcacaatctcggctcactacaacctccgccccctgagctcaaggaatcctccctcctcagtgaccccaagtagctgggtccacagatgtacaccaccacacccagctaagtttttgtatttttggtagagacgagatttcatcatgttgcccaggctagtctcaaactcctaagctcgagagatccacctaccgcagcctcccaaagtgctgggattacaggcgtgagccacagcacccggcctcctgtatgagttttatgtggacacacattttcatttctcctgggcatataccaaggagtggagatgctgggtccttgataactcaatgtttgaccttttgaggaactcccagactgtttttcaaagtggctgtactacatataatattaaataacataaattagttgcatatgtaacattatattattgtattgttttcatatacatatgtttatataaaaattatccatcattctttaaaatctgacttatattctttaatctctaaagatttacagagacacagttttatagcaagagcagatttttcatctatcttaaaatgtgtatgttcatcagtatggatatactgacacccatatcctggaggacaaatgattggaggatttccataatgctcatcacatctgttctgacgtttaagtcactgtcctttctcaaaggaaatctaatttatactccttagcacaatattgctatcttttcttagaaatacatttcacagttgaaatataaagcaatttgaggaaaataagatttttagaaagacatcgggcctgtgtaaatatatcctttagaaaattgacttcagagcgtgagcgacgcagaagacgggtgatttctgcatttccatctgaggtaccgggttcatctcactagggagtgccagacagtgggcgcaggccagtgggtgcgcgcaccgggcgcgagccgaagcagggcgaggcattgcctcacctgggaagcgcaaggggtcagggagttccctttctgagtcaaagaaaggggtgacggacgcacctggaaaatcgggtcactcccacccgaatattgcgcttttcagaccggcttaaaaaacggcgcaccacgagactatatcccacacctggctcggagggtcctacgcccacggaatctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcggactgcctcctcaagtgggtccctgacccctgacccccgagcagcctaactgggaggcaccccccagcaggggcacactgacacctcacacggcagggtattccaacagacctgcagctgagggtgctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagtggaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcagtggaagatgaaatgaatgaaatgaagcgagaagggaaggttagagaaaaaagaataaaaagaaatgagcaaagcctccaagaaatatgggactatgtgaaaagaccaaatctacgtctgattggtgtacctgaaagtgatggggcgaatggaaccaagttggaaaacactctacaggatattatccaggagaacttccccaatctagcaaggcaggccaacattcagattcaggaaatacagagaacgccacaaagatactcctcgagaagagcaactccaagacacataattgtcagattcaccaaaatggaaatgaaggaaaaaatgttaagggcagccagagagaaaggtcgggttaccctcaaagggaagcccatcagactaacagcggatctctcggcagaaaccctacaagccagaagagagtgggggccaatattcaacattcttgaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacgaccggtaccagctgctgcaaaatcatgccaaaatgtaaagaccatcgagactaggaagaaactgcatcaactaacgagcaaaatcaccagctaacaacataatgacaggatcaaattcacacataatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacgggagcacccagattcataaagcaagtcctgagtgacctacaaagagacttagactcccacacattaataatgggagactttaacaccccactgtcaacattagacagatcaacgagacagaaagttaacaaggatacccaggaattgaactcagctctgtaccaagcggacctaatagacatctacagaactctccaccccaaatcaacagaatatacatttttttcagcaccacaccacacctattccaaaattgaccacatagttggaagtaaagctctcctcagcaaatgtgaaagaacagaaattataacaaactatctctcagaccacagtgcaatgaaactagaactcaggattaagaatctcactcaaaactgctcaactacatggaaactaaacaacctgctcctgaatgactactgggtacataacgaaatgaaggcagaaataaagatgttctttgaaaccaacgagaacaaagacacaacaaaccagaatctctgggacgcattcaaagcagtgtgtagagggaaatttatagcactgaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaattaataaattgctcgacacatacactgtcccaagactaaaccaggaagaagttgaatctctgaatagaccaataacaggagctgaaattgtggcaataatcaatagtttaccaaccaaaaagagtccaggacaagatggattcacagccgaattctaccagaggtacaaggaggaactggtaccattccttctgaaactattccaatcaatagaaaaagaggaaatcctccctaactcattttatgaggccagcatcattctgataccaaagccgggcagagacacaaccaaaaaagagaattttagaccaatatccttgatgaacatcgatgcaaaaatcctcaataaaatactggcaaaccgaatccagcagcacatcaaaaagcttatccaccatgatcaagtgggcttcttccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccaggacaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccgcatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccagaacaccaaaagcaatggcaaccaaagccaaaattgacaaatgggatctaattaaactaaagagcttctgaacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggagaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactattggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaactgaacaattagaacacgtggacacaggaaggggaacatcacactctggggactgtggtggggtggggggagcggggagggatagaattgggagatatacctaaggctagatgacgagttagtgggtgcagcgcaccagcatggcacatgtatacatatgtaactaacctgcacaatgtgcacatgtaccctaaaacttaaagtataataaaaaaaaaaaaagaaaagaaaagaaaattgacttcaactgaaatttatgcactgcgcacccagctccatgaggacaagggcgatgccttcataaatgatgcccagaaagtatttgatagatgagtaactcattttctaaattaacatattttgggagagtagtttaacagcagcagtaaagccctttttcgagaacctgttctgtactgcttcggacagatgtaggtctccattctgaattcatgtccaccctgcatgttcagttcactcacactggcctcctctgtattctttttggaaaaatcatagagaaagattagcaaattgaattttttaaaaataagcctcaaaaatgttgaatgccaaaggactaaattgctaccttccattctagctctatcaactattcccggtacaaatatgaacagtaaggccaggctttgcaatgcgtgacctgacaggtctcagactcggcggggttttcagcgaaaatgggcctcaggaggcctttggaagagccaggtgggggaggctggttcactgcaagtgtatgccctggcttcagcggtgactgagccctcgtagcccaggggacatggtggatcatcacatacttctcatgggatccttcacaaaccccaccagcaccttcagcagatggagaaatcaactcttcacaggcagaaaaaaaacggatggcacagacctggggtctcctgagcatttgcagtcaggcaagagaacagccgtggggcctctgcagccagagggtgaatctcacctcagaactgactcagtgaacacggaattaccagccacattggcagagacctcacagtcagtgctgctggtaccacaggcaggacaaggggtgccgaggttggaatatgaccacagacacccggcggactggaggtggcctctgccgcagctgccattgacggcttggaccccgctttgtgttgccagcatcacctccaggtgtgcagaaaacatgacttaccggacgaccttgtgcccacacgagctccggggactctgggaaaggagacctcccaggcggagccccctgtggcacagcctctgcctctgcagtgctgggctccccaaaccaacaactacagcagcagaactgatatgcaggttggccaagccaaggacagttgctcaccctggcgacacgattttttaaaatgtaataatggggagttctggctctgggataataacttatattgaagaaacactcatacagatgacagccatgaactgtggagcccacacacacatgcattgcacgtgcacacacgtgcacacgcacacacacacacgcatgccctcctgtttgaaagcagagttgggcaggaagtagagactattcacattttaaaggaaaggcgccgcgctcactcgcggctgcccatggtcctgtgagttccctctgagcaccctcgctacctgctgcaggagggcggtaggaactgaagcagacagctgcagtctccttggatgtgtctgttacaggatggaatttggggttgccagaagaggtgggggtcagaacagaagggatggagccatggagggagaccccaaagtctattaacatttgcggacccctgaaaaagtttagtttccagctgctgaccaccgatggtgaagatcagtctggaggctgaaccccaccaagtgcacaggccaggtaaaccatctgcagcctccccaggcccaccccagcaacgcacgagccaaacacccaaagctaaggaggatcggccacaaccaaaattagcacacattggaggagggagcaggtgccggggtctctgccagtcgtgtcctttatgccgaaaagaggctgaagttgtagcaacatgaaacccacctgcaaggaaaaaactgatgtgctcaaaacgaagcctgagaagaccccgatggtagaactcaccagaaagatctttaaacagccattgtaaggtcttatgaatgatataaaaatgttagaactcaccggaaagatctttaaagcagccattgtaaggtcttatgaatgatacaaaaatgttagaattcaccggaaagatctttaaacagccattgtagtcttatgaatgatataaaaatgttagaactcaccggaaagatctttaaacagccattgtaaggtcttatgaatgatataaaaatgttagaactcaccggaaagatctttaaagcagccattgtaaggtcttatgaatgacataaaaatattagaattcaccagaaagatctttaaagcagccattgtaaggtcttatgaatgatataaaaatgttagaactcaccagaaagatctttaaacagccattgtaaggtcttatgaatgatataaaaatgttagaactcaccacaaagatctttaaagcagccgttgtaaggtcttatgaatgatataaaaatgtctgttacaaggttaaagatgttaaaggagaagaaggtcttaatgcctgactagatggagaaatgaaatccatgagaaagagacaaattgaattttcaagaacagaaaaccacaatatctgaaatgaaaaatttatgggatgtgtttaagagcgaattgagagagcaggaaaaaagcttagtaatttgaaaatgaaacagtagatattctcaaatatgaaaaagtagaggtaagatattaaaaaaaagaatagagcctcagtaatatgtgtagtaagaagaagtgaagggacacacatataattagagaaccagggagaaaactgagagaatttggcagaaggttttgaagaaaaaatggccaaatattttacaaatttggtttgaaagaatccacagacccaaaatgctcagtgaactctaagaagataaatagaaaaaaatcatacctagccacaaaatagttaaactgtggaaaaccagagagagacaagtctgtaaagcaaccaaggaaggggtcaaacagaaaccagaggaataattagaaaattatgactgccttattgtcagaagcaatgggagccagaagacaatggaatcatacctttaaagtgatcaaaaacatctattgattcagaatactatacccagcaaaaatatcttttaaaaaatgagagcaaaataaagacttttcaaacagaagctaaggaatctatttttaacttaaatacatgtatccacatgtggctacttttttatctttcatttagtttcaggggtacatgcacagatttgtgatttaggtaaactcacgtcatgtggggtttggtgtacagattatttcgtcatccaggtaataagcattgcacctaataggtatttttttctgatcctctccctccttctaacctccaggaggccccagtatgtgtagttttcctctctgtgtccatgtgttctcatcacttagctcccacttataagggagaacatgcagtatttggttttctgtccctgtgttagtttgctaaggataatggcctccagctccatccatgttgctgcaaaggacatgatctcattcttttttatggctgcatagtattccacggtgtacatgcaccacattttctttatctgtctaccattgatgggcatttaggttgattccatgtttttgctatagtgaatagtgctgcaatgaatgtgcatgtgttttaatggtagaatgagttctcttcctttgtgtgtatacacaataatgggattgctgggtcagatggtagttctgtttttagttctttgaggatttgccactctgctttccccaatggttgaactaatttatgctcccaccagcagtgtatgagcattcccttttcttcacagcctcacagcatctgttgtttgtccactttttagtaatagccattctgatgggtgtgagatactatcttattggggttttgatttgcatttctttaatgatccatgatgttgagcattttttcatgtgcttgttggccacatgtatgtcttcgtttgaaaagtgtctgttcatgttctttgcccacattgttttttgcttgcaaatttgtttaagttccttatagatgctgggtattagacctttgttggatgcatagtttggaaatattttctcccattttgtacgttttctgtttactctgtcgatagtttcttttgctgtgcagaagctcttaagtttaattagatcccattatctaccataatggacagcgcacctctagagcaaccactcaaatattaacgctatgcattacagccaatacgagctaaagctcaatgttaaaaatatttgattaacccaaaagaaagcaaaaagaaatcagaggaacaagtatatgaataggacatatggaaaacaacagtaaaatggtaggcttcaacccagtcataataatacgtgtactaaagtaagtggaataagtaagtaaaaggctacagttctaaccctggggaaaaaatgtcaacattaagggtgcaacatttaactccctccgtaagatgagataaaacacgaggatgccgactctcagctcctctacttaacattctaatggaggtcctcgccagacacagaaggcaaacaagaagagaaaaagcacgaaatttaaaaggaaggagctccttccatgtttaggttccaggtttattcttatatcacatgattgtttacatagaaaacctaaggaaactacaaatcaaatcctggaacagatcatgccattcatcaaggctaggacatgaatgaaataggtagaaatcaattgcatttctgtagacccataatgaataattggaaaatgcagttagttttaaacatctcaacagcattgtagaattgtggtgctctaagatagaccatctaaataaatcgagagctagactgtgatgcattggaagtctcagtaatgtgaagatgtgaaatctccccagactgaggtatggattcagtgcaacctcagtagaatcaatgtcattcaaagcaacctcagtttttagagaaactgacaagaagattctaaaatgtgtgaaaatgtgaagaacctagaagtgccaagacagtcttgataaaaaagaacacagttggaggactcacgctatctgatttcaagacttgcgttaaatctaatcgggacagtgtgatattcatataagaatagaaaagggtctctcagcctcagcactcttgatatttggggccagacaattgtctctcattggggggatctccgtgcaccttcagcattcttgatatttggggccagacgattctctcttgttgggggccctctgtgcactgtaggatcttttcatggcatctctggcacctgtccagtagacacgagtagcaccctcctctaaattgtggcaaactcaaaatatctccatacatcaccagatgtcccttgagggcctaatcgccccagattaagaactactcaaatagacaaaatagatccgtgtgacagaatagagactccagccgtcaaaatctttaaattctgttcattaaaagacacaactaagaaaatggaaaggcaagccatagaataagggaaatgtctgtctgacaaagggcttgaatgcagaatatgtcaagaactcctacaaaacaagaacgtaaagacaaccccagaaaaatgggcataaaagccaaaaggttactttgcaaaagaagatacacaaatgtccaataagaattagtcatccaggaggtgaaagtgaaaactttattgggatacacttcaatttcactagaatggcctaagttaaaaagaatgacaatacaacatgcccaagaggatacgggtggaggccacagtcaacatctgtcaaaactcactgagtcctacaagtgagacctgtgcctttcactgtctatcaattttctctcaattaatacaatttaatgggtatatatttttctgtttcatttctatgtaagaaagaaaaataaattttttggtaagtttaccttgttcttttaagaaaaatttaaacagttgaaatattttcttcagaccagttgtttctgagacatctaccaaatgctaaaatctcgagtcacaatacaggtcttgcaaggacaagttaaacatagtatgtgttaacattaagtaagtgctcaccatgtattatacttgtattgcatgtaacattcttaccttatattcacagaactccataagttatgtcctgtgactactgtcctcattgtacgttgcatagattaagagatttgtccaaatgacaccgttggcgagaggttgagccaggatctcaatgtgggctttcaggcatcaacacatgtgctccactgtgcatacaaactgccttctgcgcaccatgttacttccgacctgtaaagcacatttcacggccaagcacactgttggcctcagcatagcgtttcctgtagacaggaaaaatgatcccaggcccgcctctttgagtgtctttcccatggtgtcttattttcaccttctaaaaataaatgttcacgttgcttcatccccccatccaagaaaactcacagcctttctcaaatcgcctgtcctctctgctgttcctgacaagttgttcaaaagttccactcatacttccattttcttaccttaacgtctgcgatctcatttctgcacccatatccactgaaactgtcctttttaaaaatgaccccagcttgctgcatctgacggtctttccccatctcattccacttgatttctcagcatctgctccggggccgggctcctcctgtccctcgggtgcccaggagcgtcccccgccccacgcccctctcactttcctcctggattcccttcgtggccccgcctcacctgagaggcctcctccacctttctgctgcgtgacactcacagcccgacgtcttccacacttttacatctgaagcactcagaggttcacagccctgcccgtcacacttgctctgttctttcacagacttcttggaagtgccctagaatcagcaggtccaaatcaaactcaggtccaacctccaaaacctgtttttcttcctatcatagatcttgcctttgttgggagaagtctaggcgccttggaatcatctcacctctaacacattcctcattcctgtgggctctgtccctaaaatccaagccctttggtgtctcatgagaaaccagctcaagtctgcaggagcctctcggggtctgtgtccaggacaccacttcctgcattcaggcacctcgtcctccaggccccacgcacagggaccgtcctgagctcccagctcacaagtccctgattaagaacttgcagtacttttcttttgcctgtggcataaacatcaagctgtctggggtgtccctcacagtttcccactctgcttccccaaacttctctcccagaatgcctttccccctttaccctctgctctccagacaaacaatgctcactccccgcctcccagctggcacacactctacatttccttttagcattttgcattaagaaatctatgttccagtctttgtccccaacacactgtcaactacacgagtgctacgcttgccatcttgcagaaggcctttcttgcacttccaagcacccagacttacgtgggaggtgccttattaagatgccttctcctcgtgttctgtttgggaagcctttggtggcacatccttcaaacctgcccagtcctggttatagcaaaggacgggtagagccaagtggacgagagccggaggtggttggtccggctgggtcagggtcagctgcactgggaccagggcagaggagagccagaggaggttgtccacactgggttggggtcagctacacgaggaccagggcaaaggaggttgtcatggctgggtcactgttagctgcactgggaccagggcagaggagagccagaagaggttgtccacaccgggttggggtcagccccgttgggacccaagccagcgtcatgcatctgagcatgctggctctcactctcagctggccgtgggtcagccattgcagccccacctgccacgggctccaggaagagcagtcatcagtatggagaaggccggactctgctcagaagccactgagcaggtgctccatagactcaccagctggagcggggtcacatctcggaggcaccgtcagcaccaggagggcagccaagcaagggtatggcatttccgagcctctgcggtcaagggtatcgcatttccgagcctctgcggtcaagggtatggcgtttccgagcctctgcggtcaagggtatggcgtttccgagcctctgcagtcaagagcccagagatgggttgtcggggcagctgtgggggcatcccagatgtgggtgccaacagtgagatgcaaatgtggatttccctcaaaaatgtgctgttagggaacaagcatgccttcatctcctgcaagggcacagaaagctcaagaacactttttaccctgaatgtggaaatgatctggaaagaagccattttctgaaatccagtcattaattgtgatattatttgaaatgtatactgaaaggtgttctaagaatttccattttgcaggtggaataatacacacatgtgcacgcacagcacacgcacgcgtgtgcacacgaatgtctgtttcactagcactgtttagcgtgctccattttccattgaatgcagtggaagaaacacttcttatatttgggagcttctcctgtcagatcccatttatagaaatgagaagatgatctctgtatttcaaatgaacacatttagtatggaaaaaaattttcttaaatatctccttagcacaacctgcatagaatccttactgctttccaaggtaacaagggagatggtttacgttgtgtattttcaagcatgtttagatggatctaaacagctggggtcagaggccctttcaggggtaccctttgttatgtatattcgttctcataatgacctaagtcacagaggaggttctgagcccaggattcagcaagcagctctggaaccattcgcaaagggcgagaacaaggttgaacaccaggaatcctgcagttctgtcttggggttatggattcacttgcacagctttccgtctcgcctgtttgtggatgacaatctaaggggagcaacatctgaaaggcaaaactagaacaaaaacatttctgtgttattctagaaaacttttcactatttaaaaaaaaattctgagctactaagtccatatagcaaaatatgtttccatttctgacacctgggatgccgcaggaattaccacttagagagataaccaaaggggctgaaagtcaacttcaaaatgccccgggatgtaggagggggattttcagggggaagagtcaggtggattttgtggagtgagccgtgctggggacttcaccctgtgtcacctggcggggccaccggagggtgcatccccccatcttgattggctccccctagtcctagttcttgagttttgatctgtgactgtgaggaacctggccttctgggactctatatgataaaatgctaagccattataatattttttaaaaagcctcttaagccaaatgaggctgaggttttatttgttattttttaactatttaaaaagtctgtggtatcagaggatgggatctttggctctgtggtcctatgactcagcatcttgagtgcttaaaatcccagtgaccttgggattttaaagcatgaattccagagccaggccacctggactcagaagggagtgctgcccccatcccgcccaagcctgagtgcatgacctggcaccagtgtgtgatgacctggcaccagtgtgtgaagacctgtgcgtgatgacctggaaccagtgcgtgatgacctgacaccagtgtgtgatgacctggcaccagtgcttgatgacctgacaccagtgcatcatgacctgacaccagcgcgcaatgacctgacaccagtgcacgatgacctggcaccagtgcgtgatgacctgacaccagtgcgtcatgacctgacaccagtgcgtgataacctggcaccagtgcgtgatgacctgacaccagtgtgtgatgacctggcaccagtgtgcgatgacgtggccccagtgtgccatgacctggcaccagtgtgtgatgacctgacaccagtgtgtgatgacctggcaccagtgcacaatgaccttgcagcaatgtgcgtctgatgctgcattcataggaggaaggttgggaagaggcctggtttataggactaatgtaaacattaaatgtgttaggacaatgcaaaacacttattagcatttctggcgtaatcttgcatagaaaatgttagctattgtgagtctatgttttaaaaaaaattattagctttcttcagcggcaacatttatgtgtcacactccattttgaaataaagagaatcattgagagaatatgtatttgaaacatagactcacaaaatacatggatccacctgtgagggctgtccagcagccactgccagagtgatgagccatggctcagaggtgatcccttcgttcacgtagcaggcactggttagaaactgtggacaccagatccagaggacgagaatccttcttttatgttttctcagtctagaaggcagcttcaatttgagaatgttaaaatgcaaaacggtggtgttaatcagaaggaacggctgttgtattggaagaaaattggtaattggtagaaagtgccgattggtagaaatggagggtatgaaaccagcaatctcaaggaagcatggaaggagagcagaagtgcgggaagtttacatttctgcaaagacaaaggtgagtcaagttaagagcctcagtcagggctcttggcatccacctgaggccacactgctcgggctccatagctcggggcttcgtccgctgcacatgactctgtattaaacacgcacaggcacgtggacacattcaaaggaagccagcagtggtctcttacagaatgagtccacgcatccatcaacctgagcctgaaacttgtgaccgtgtctcaggatgctgttgacattttgccgctctgttgaacccatgctttcagggtggtgacagccaaggtcagggatccgtgttagctcgccttctgttcactggcagtcgacctgggggatccacagaggaggggaggggacagggcccctgctggtgctggtgccggtccccacatctgcagcagagctgcccgtcccactgcccaggtgcagcgggagtcggcgggcatcgatgtgaagactgtgtgcttcatacccagtaaaattagaatcagctcaaaactaatttcctccctttgctttctctctctctctctctctctctgtctctctctctctctctttcctttttttggtctaagtcagggaggggaaggtaggtaggagctgctatatgttatacattttcttttaaagcaaaaatatttagcagaaagaatgactttaaatctataatgaataagcttcacttaataagaattcattgagtccagttttttttctctgatattccatttttaaagactgaagtaaatcagagaaaaaccacaccaagggtttactttgaaaagaaagtgtgtgctttaatgcccaactctggagtcagaatcgtccacctaacatctatagacatttttatgtacctgcttgtgcactgatatttaatgttcctattatcatccaaaacaggcaagaagaataattaatcatttctgtccacatttctacagcttttgataaaataaaatgaattttactgcactgtggaaagattgtcaataaaactggaaagtggtccagttagccagaagtttaagctaagccagacctttcatcggccaaacactcacagggttcttccatgcttttaacatttcacaaaacggcgagaaggaagaccagagaacattgatttattttaagggagtttggaagaaaacgaccgttgtgcttataaaatggttttcatttagcctactcctcctattatatttgctgatattgcataacctggacaactttgcataagttaaaactgaaagtgagccttgtattttttctgttattttttaaatatgtaaagttgccagagagccaataatttttatgagactctcagttttttggcttaaattcaggagctgagtttgctattatgctgtgtgagttactagtgcttacagcacttttttaaaaatatggaatgacccaaatttcactacctggccataaaatctcaggtttcaaaggcaattttgtaaatagcctcccctattacttttgatgaaattcacattcataaatatgaatctcagaatatttgcatatggcaaagttactcatcaagacacagacattcagttggaaatgtgatgctagcctctgggtgtggattggacggtcgttcccatctctggcctgtggcgggtgctcagcctctgggtgtgggttggacggctgttcccatctctaccctgtggcgggtgctcagcctctgggtgtgggttggatggctttcccatctctggcctgtggcgggtgctcagcctctgggtgtgggttggacggctgttcccacctctgccctgtggcgggtgctcagcctctgggtgtgggttggacggctgttcccatctctaccctgtggcgggtgctcagcctctgggtgtgggttggacggctgttcccatctctaccctgcagcgggtgctcaccctctgggtgtgggttggacggctgttcccatctctgccctgtggtgggtgctcagcctctgggtgtgggttggacggctgttcccatctctaccctgcagcaggtgctcagcctctgggtgtgggttggacggctgttcccatctctaccctgcagcgggtgctcaccctctgggtgtgggttggacggctgttcccatctgtaccctgtggtgggtgctcagcctctgggtgtgggttggacggtcgttcccatctctaccctgcagcaggtgctcagcctctgggtgtgggttggacggctgttcccatctctaccctgcagcaggtgctcagcctctgggtgtgggttggacggtcgttcccacctctgccctgtggtgggtgctcagcctctgggtgtgggttggatggtcattcccacctctgccctgcagcgggtgctcacagaatgccttttctcctttcttctttcctgtagccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtcagggtcccttcgccctttctccctggggtccagtctccccagccaggctggcacggaggccccggccgcataggtggcgatggcgctgccctcctggtcagcagcacttgggcaaggctacaccaaagggggttcccctggaattagctctggctgattagactcgtggacttactgttatatttttgacgtgtataactccatatcatttttgcgttgatttttttctgaggaagcaatgaccaaaagggtggtcatcctggcctctcttgttgataaagcacaggctgtcttccttcttcccaggctatttttccagtaaaagggggccagggaaaggctctggcagcatggctctcagctctgtcctctgaattgtgcctcagaaagtcctgtgagaggatagcctggtgtcgctcacagagtcctgccggtcggccccactcccagggcaggactgatttcgggacaggcacagtggccaggagaagggtccctgggcaccacgggaggggtggtattaaaatcaggtgcctgagacacgggggctgtgaaagggaggcccccctgctccccacctgtggtggacgggcctgagaacgcacagtgaaaaaatcggcaagtgtccttcagtctaatcatcctatattacatggcaaagaagaatcgaaagtttatcattttaattaagcacgttgcttactcacttaaatgcctttgaaaacagtgcttgagctgaccttgagtttgtatacctaacaaacattttctcttagtgtggagtagggattaagagcctgagccgacctcacattctctctgacttactgtggagtagggattaagatcttgagccgacctcacattctctctgacttactgtggagcagggattaagagcctgagccgacctcacattctctctgacttactgtggagcagggattaagagcctgagccgacctcacattctgtctgacttactgtggagcaggaattaagagcttgagccgacctcacattctttctgacttactgtggagcagggattaagagcctgagctgacctcacattctctctgacttactgtggagcagggattaagagcttgagccgacctcacattctgtctgacttactgtggagcagggattaagagcttgagccaacctcacattctctctgacttactgtggagcaggaattaagagcttgagccgacctcacattctgtctgacttactgtggagcaggaattaagagcctgagctgacctcacattctctctgacttactgtggagcaggaattaagagcctgagctgacctcacattctttctgacttactgtggagcagggattaagagcctgagctgacctcacattctctctgacttactgtggagcaggaattaagagcttgagccgagctcacattctctctgacttactgtggagcagggattaagagcttgagccaacctcacattctctctgacttactgtggagcaggaattaagagcttgagccgacctcacattctgtctgacttactgtggagcaggaattaagagcctgagctgacctcacattctctctgacttactgtggagcaggaattaagagcctgagctgacctcacattctgtctgacttactgtggagcagggattaagagcttgagccgacctcacattctctctgacttactgtggagcaggaattaagagcttgagccgacctcacattctgtctgacttactgtggagcaggaattaagagcctgagctgacctcacattctctctgacttactgtggagcaggaattaagagcctgagctgacctcacattctctctgacttactgtggagcagggattaagagcctgagcgcagggattaagagcctgagccgacctcacattctctctgacttactgtggagtagggattattctgggcttctgggccaaggcctgggctttctgtgccctcccattatgcagttatcggcgtgacaatggaagtacacagtcaattttagatgctattaggcaaagagtccagcatatactgagcactcaaaaatgatagcccttattattaccatgataacaataagtaatactatataattctgggcactaaagccctcctggctgcagatcatgctgtgagctcttggtagcttgcctggggctcagtaagcacaagtctttcttttgccgcagactttaaattcctcatgaggtagagtctattcattttgcaggttttttcctcatcggaaggttgtacccaggactttttccactgaactattgaggcttttcctattgcacaactcaagaaggataccacctcttttatctactcggttacttctttccttccagaaatggaattaagttctcatctgcatcaggaattgcattgactctttttcccaatgacaaggaaagaccgtccctagccctgcgctcaagtcctgggcaaatgggaatggtgggtcctccagccccctgctcccagccagccccctgcaaacaataacatcaactgatcctccccaactagataattgtaattattttaataactgaggaaacattctatttcagcataaagtccaagatgatatggggagacactaattaactaaacagagtaactgaaagtcagtgatacattttaacaacttgctccatacacagagatgaggatacagcagactttcttcttttaaagctatcaccttccctttcagtggatataacctagtttaccaaaatacagctttaaaaatccgatgtaacccaacaaaaggtttaaacagaagtgcaaagttatctcatccgaggtgtgaacgttcatctctaatacttttccacaaacaactttcaattaaatggatctcacacctctttaaatgctcttatgaaacattcagaggctctttgcgactcgtcgtcctgtttgggggtaaatgtaagctaaatatactagttctctcgtcatcttgcttttgatgaacccaagatggtatctaccaaaataagtcagtgaaaataacattttctcacatctttgtctatctgaaaggattcatcattggaaacaatggttaagcagacaagttgggtgcttgggggtttatttaacgaccttgaaatttagaattctaagtcattcctatgcagagttctatggcattactttaaattgaactcagttttgaattctcaggaaaaaaaaaagtgttattcaaaataatcctggaatgctggtagtaagtgagactgtatcacacccagaaacaaacgtagtaggtgagaagactgtgtcacacccagaaacaaacttccactaattgattgtccagccctaggccacgagacctgacaattctggaaggaaggggacagtgcccatggttgagggtgggacatctggaattactaacacttaggggctctggagagatgtgaatttggtgacaaaccaaagtttgttgaaagtttgcccttggccagtcgcggtggctcacgcctgtaatcccagcactttgggaggccgaggtgggtggatcacgaggtcaggagatcgagaccatcctggctaacatggtgaaacctcgtctctactaaaaatacaaaaaattagctgggcatggtagcgggcacctgtggtcccagctactcgggaggccgaggcaggagaatggcgtgaatccgggaggtggagcttgcagtgagccgagatcacgccactgcactccagcctgggcgacagagcgagactccatctcgaaaaaaaaaaaaaagtttgcccttcatgtttaacattcaattttttctcaagcacaggaagggaattaaaaatctaactgaagtcttgtgagaggtgcttatgtccatgccgtttcctccttggaacctcagtagctgcactctgcttgggtttcctgcagctcatgtcccgagggtctcggcgggaggtccgggtgtcccgagggtctgggcgggaggtccgggtgtcccgagggtctcggcgggaggtcccagtgtcccgagggtctcggcgggaggtccgggtgtcccgagggtctcggcgggaggtccgggtgtcccgagggtctgggcgggaggtccgggtgccccaagggtctgggcgggaggtccgggtgaacagatcattttaattccctgctggaccatcttgagatgctgctcaaccactttttatttgttttggggaggaggagtcaccttcatgtctagaacctcactgaaaggcttgtagctggaagcatagccgagggtccttgctgagatgccagcttctgtttgtgaaatgcacataccaggttaatggtgtctcttctttaggagcgagggcagctgggccctgggtcgggcttacagaagggtgtccactgaggtgtactagggcctcacacaggttctgaccttctcacgctgtctacgatacatctttgacaggaatgacacaatctaagacttttccataaaattctacataagtgaaaacttacattggaagaaatttatggtccagaaaaacatcctgtttccaagccagtgtgcatgcttctgagccctttgctgggttcctgaggccatcctgccggctgtgtcctggttgtgcctgcctgggtttgtctgtctctgtccagtgtcaggaatcctcagacctttctgaaaaaggccaccccgccggcattgtgccaactctttctgcagcctggcatgggtctgtcttccctgcagggtggcttcaggctttgctgccctttgctcaccccctgcctctccagggtccatgctgagttaggctcacgaggaaagaggccgtccttccagcacgtaggtcacctcaggtgaaaccagagaagtccacaggtctgaacttggagacaggcaaccagtgtcgtgttgtgtcaacaacacaactgctagagggagaacctgattctttgaccttgccttttactctgctgacaactaaaggaaaagaactaatctggtgtttaaaacagtgtatttttacaatgtatctgccaacataatccagggggttcagaaagctgttggtgctttgagctgtcacacatccccaggagaaacaagaagagaaataatctgaatgggagggggtgaggggagaaagagagacaggggaggaaggatggaagggagggaggatgggagggaggggaaaatgaagtgagtatactaatatcctaagctaaggaagaataaaaaaagcctggaatttaggtaaagtagcacatttcatgtggacgaaaacaccagtacagccatttctttctcatctggactcagatatatgctgccgtaatggggataaggagatgagtttagaagccaaatttgtgatgagttgccatggcaatgggtagaagcagactccatattctgaaaaagaactgagtagtgtatgcactgaatgtgctttcccttatacggcctcagtgcctggagccatcgtgccattagtagcttggaaagggggggccgtcatgtgggaaagggaaggaagaaatggattctgaacccttcctttgtaccaggtactttgctaatcttttaaaagttctatctctcttacactttgtaataactgtcagccttaccttgaaggtttgccttgcggtcccccagaatttcatcaacacttggaattggctgtttgcctaagtgtttcgtaagggaaaacccaatgctgtatttcccaagctcagccgatgcccatgctgacttcaggttaactgtgctgaactatgaggcagtgaaaggcagcctgggaatgagcgcgctctcctggcttttctgtaacgtgatggtgaccctggagggccggggcatcacgtgtgctgttgatgattgcaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcaggtaaggggacgccattttcagccttccagcggggactctagaggcatacctgtcttcatcctagaaggagcgagcagcacacagcaccacagtacaatgtactctcctgacatctagtaacgtttcctaattgcatgtgttacactgtcacattcgcaagggtgttttgtctcttgtagataacctttctttttcttagaatgaaatctactcattagcaagtttccttaaaataatcaagtgtaacttgtgtaaagttttagagaggagaaagaaatggaagtgctagcatttggaaggtgattaagttttaaataccaaagtttaatggattgcagtgagatttctgctgatgcgcagtgactctcaggctgccctgtagtgacgtccagccggtctcttgctcagtaagcagatctgtaaacatgactcaccgccgctaagcaggtccatcattaatgcagatgcactaactatcttagagctccgaagactcagtctcgcaatttcctttagttctcatggaaaaccatacccacccctttgaaaatttaccgcccaacctaaatatcactgcctaatattttactgcctaatatgttattatttctataacacgatgaatacacatggcctagagaaacccataaaacacagcaagcaataaaagctcgaggcgccgcacatagaggttaaggaaaggagctataaaaaaacatagtgttggggactgaggtgttctgaataccagagggcttggaatgctgcagctgtatcttagaaatttaaaggacagctccgaggggaaatagaacaaagctatgttcatgatgaatagcattaggaacagcagacacataacaggagagaagcaaagagaaattcaggcaggagtgtgtcatcatacctgtgaataggtcttggtttgtttcaatgctaaagtgaacaagaaatccaggagattgcactttgcagaattagaaattgcagtcggcactatcattgcactttgtgtagaaagtatttcatagtagagtctgtggatggaagggaaggaactgtgttcaaaccgtgttccatcatgtcctcgctgcaagaacttaggcttgttaacgtttctgactcttggtttctgcggtattcaagagaagctgtagccatagataatttatttgcataaatttaaagattatttttcaaagaaagctgtggatcctcggtgtgctttttatgtggtagatatttcttcaatgctggcaccactgagccgggggcttcgggagaaaggcaacagatcctggctctctggctcccagcagggctttctgtacgagggagggtggtgcccaggacccacccaagggaaatccacaggctgacaacacatcccccaggtgcagccaccgggcagctgtgggcaccctgcgtagcctcctgttttcctctggtttggccggttctgctcactcctgccccttggtgaagtcctgggccagttctcatgctctgtcctgatgtgaacattgaacaaattagaatcagggaagtaatgagatttacaatgattgcattgaaaaacagcggtccaagagatcattactcatactttcagcagtatttgtttactgtctcttaggagcaagtaaacaattaagaactttcatagtcttcagaaatgctttgaaacaatcattacctcgtagaaaaggactttattgtttttaggactgtcattatagagagaataaaaataaaacagatttcacagagataagaaccagttctgagctcagactaaaattttaatttatatatatacaatgtttaccatgtatattttgtattccaaaaatacacctaccaaataaattacaaaaaaaagattccattcagagtttctaccggatcttggcccagttttgagtcagaatttcctctaggtgatgcaggggactgtccaagttatgtgacatctgagaatcaaatgagaaaagaaatgaaaagcactaggggaaatacttagcactgtaggattacaagttacccttgtgaagaaataaaagtacagattaatcattaacctctgctgtttcccattttactctaagtattgtatattagttatttaaatctttatttactaaataaaatttagatgacatgcaatatagtctatttagcaagattatggaaaaataccaaagaaatgaaaactcccagtctgggaaaacaaaattatggaggaaaactatcaacatgtacgggatgtaggtgcctcgataattgtgatagctgaacttcaaatttcatccaaagtttcctgtccgtgagtcaggcggatttcaaaaattttctacttaaatacttctgacttttgtatttaaatacttggaaattgatatcctagcactacgttcaatagctgtcatttactgatccatgtatacatgtgtgtatgtgtgcgtgtgtggtgtatggggagagaggttattttgacagattgattttcttttatgattttctgtctaaaactagctcatgaaaataattccaaagagttatttttgaaaacattccaaagtgagtaccttgaagaacgagatttatttaaacacattactttatgcaggctcaaaaggtaaaagttgatgttattattagattatttcaccttgtataactacaaatgtataatattcatataataataaatattgaatatatgcatgaaagatgtattgagaacttaaaaatacatcttagaccatctgttttaaacatggacaggttgaggttcccagaggacgtctgttggtttggggacaccccagttcacctgctttttcactcaacctttaaaggcagctggtgatcgagctgagacagacccttttaatctaatcaccagggaactccagtaagaacagaataccctgtgaggcggtgtgagccacgcatataaacgttccttcgtcccaccgtttctctcattatgaaaaacactgcatattgattagtgtcctccccttaaatgaagtggttttgaaaacatctaactcatttcacacatggtttctttctcatctgggaaattatttatcggattgctttacttgtccaaatatgcatctcacccgatttttctagggagggaatattattgatattgtgaaggaaaatggtgtaaaattagattataatgatttttctctgggccggaaattttctcaacatatgatacaactgattctagaagtcattaaaacaaagggaaaacctatagaaagcatggcagaggaaacagccacagacttattttattatttatatttctatagcaacttgtctctcaagggtacatagtaattccatttccaagatacatacttgccaacatagaggagaaaaattatctctatatttcagtaccttgaatataagaggtagaataactgtttttcaatactatgatttttgttgcttttttaaaattttacttctttgctgaccttcctcagtttgaataaatatgactatgtatttgattctcccatttttagtcttttacaataaaagacagtgttttacttaattttatcttgtcacaaagagtggattttcaggcgtgtgagcctggggaaattttcatcgtggactaaacttgttgcctcaaccttcttctgataccaggacctggtaccgtcgagttactgtgtaactgatatgcaagtttgcctgacaagatggtgagaacatattttaaaacttgaatttgaaaaagtagagaatttaaaggaaaagaaactgaaaatggatgtcagctgggctgatcataaaacgttttggccaatagagtaaaggtgatttgaaatcacaaaataccgcagggcatattcaggtgtgttgggacacacaggcaccacttggtaaacccggccgatggctgccgagtgcgcagcaccccaggttggagggaggaggtgcaccccagaggaggaatacccgtctggccgccggctggctccgcaggcaggatgtctctgcagacgtgcttgctcggggaccaggtgtgcagtgtgcagcctttccaggtccacatacctctgaccgggcccttcaccctcctatcctcctttcccagagggctggcaaggaggccctgcagccagcttccctgcggagttaaaataaaacacgctatatggggaaaggctttgggaaggacatttagctctttactggaaaaatgagcagctggaggttctgtgagccacaaaatctgaaaaccagaagattcctccaaacacgtcttctccttggatctgtcactctgacacaagggctttacaaataggctcagaaactgttgcgcggggctctcagatgcatagcctcaggtcatagctttccataagtcaacagctatgcactgcgaggaccagcctgcacaccccacaaaggcaacaaaaagctgcgtttcagtaaacaaatgaccagaggaaatgaatgaaaaaagtcacacatgatcactttccgttttagaaatgtaaaaaatgaactagaataaagaacaatcatcttatatgccaattgaagattctaaagaaaagatcaaattacatttatgtcgtaagcatttattaagtgtttgctgtgtgccggccgctgcgctaagtgctctgaatccagaagcactgaagtcctgagcattggccccgaaggcctaaagtctggaaacagttgcagttgaagagctcgtcagccatggcacacctgctgggtgctgtgagatgtgtgtggatggctctggaaacccaggggaaagccagcactgcagcagcgtccgggaggccttccgcctgcaggaagagttgagaggcttcagggctgggcagcagaaacccagggagagggaggtgccagcctgaagtaatgacaaacgtcccgaaaaccgctgggcacctcagctctgggattcgcagggcacccggcctggagggagaggctggaaggcaggacggatgggggacatgagctgagagggacatccatgctgcacctgtagtacttgcacctgcagaattcggaggtcactggaggactctaagcaggagagggatctgtggctgagttgtgttccccggacttggtgctgaaccctaatcccaggacctgagaatgtgactgcgtttcagacagacccttcgaagaggtgaccaggtagaatgaggtcacagggggcccaaatccaatctgtccggtgtccttataagaagaggagatgaggacacagacatgcaggaagggaccagcttgtgaggacccggggagaagacggcatgtgcacacccaggagaggcctcagttttcccagcgccttggtctgggactcacagcctccatgacatgaatcaatgttgctctgttacggcagcacgggaggactaacacgggggccagagtcatgttataatgaagacccgcggcccggccgtactgcagaagagcacggagaagacagctcctcaaatagcacaggtgagaagggatgaggccgggctgtgccaggcacaggtgcaggaatggctttcagagggagctccaggggctcccggctgagctctggggagccgtgaagaggcttttaagaggcctcctgccccagccgtggatgaggcccagaaagccagcatgcaggcagggagtctccaggacttcatccaggaagctgggtctcccggggagtccaggaggagaggccgtaatgatggctccatttagggacagacgcagagaaggcagcggatgcatgcagatcccagcgatggggctgtgccgttgtctcctcctgctgaagcaacaggatggaggtgatgctgttgcagcccagagagctgggtcatggagtgcaggtaaaagaagggatggccagtacaaccggggagccgggatggattgggatgaagtgcccaacagccctctccagctgctgcctctcagcagccgaagccaacagggcccagcccacaggtgccgagtagttcagatgtgttgagctgagggtcccatgacttgctaacccaacttcaagaagaggtgtggaggtcgaggctggaggtgcggtccagagccatggagccacccccgaacaggagggtatagaaagagaagaggcctgagaccagagcccacagcgtcagcatcgtggggagaaggggcctccagaaggagcagtggaaaggtgggagccaggagggatggggaggggccacggaggggagttcaacactgccccagttcaccacagtgggaacagaggctgtccctgggtcttggcagtgtgggcagagtcctggaaggctgctgcgaggcctgaattgtgcagcccctctatgcggagcagcaggggtcctgtgccacccccgacccagggtaagcccaggttcctggtgtccataagccctgcacaaattcagcacagcggagacccctgtgggtcctcccagagacgggcctggactgaggaacccctacaaagcaggtgtgtttgtctcatatttgcagctgtaaaaatggtcacaagccctatggtctccagcagcacagatgtgccgtctcacagtcacagaggttagaagtctaaagtaggttctgtggggctagcgtcaaacatcaggtcgttctggaggcttccggggagcccgctccttgcctcctcaagcttctggagttctctgccgtccttggctgcgggccacatggctccagcctgggcctccattgtccaagcctcctcgtctgactctgaccccctcccttcctcatgtaaggaccctggggataacactgggcccactgggatgatccaggatcatctccccatctcaaaatcctgaatttactcacatctgcaaagtcccttttgccacataaagtaccatggtcacaggttctggggactaggatgcggacatttttggaggggcgttattctgtttaccatagtaggttttggtaaatactggtagagtgcatgaatgaatgaggtcttctctgaaaccgagcccagtataaatggtgacatccttcaggcactgacccaaggggaacccatttctcttctaggagtattacacaaatccttgtcgtaaatccaggttgatcctgatgaagaggagccaaatctggctcgggctgatggacgctgtgtgcaggctcagagttcaccctgggaagcccaggtgtgctgccccgtgggtcctcagtgtcagacctgctgctgaagggaagcccaggcgtgctgtcccatgggtcctcagtgtcagacctgctgctgacatcacgtctccaaccccgcagcacagcgtagtccaaatgccagaaacctggcaacaacgatatcgtgcgggagtcggtccgagatgtcccagggaatctgaacgtcttcccagccgctcaggatgtctctgattgtcatgatccccattagaacgtctcagaaactgccaaccaccatggcttccatgaagccccaagaatccttcagcaaagctccatgttgcaaactaaagcccagggtgtgcatcatgaagacgccatccctgtgtcccgggttcagaggcttgtacccgggactcgggcatgagaccccattacgggcctgagcacagcaccaagaccgtcaaacgctaaaaacaggcacaggtggaagtctcacgtggcccgcccccccgcatctagacttgtgttttacagtaaatgacgaaatgcagtccagatacctaaaagatgaaaactaatctttgtgattttcattgtctttgatttatttgaactacagccaaagccttatgtactttatccgttgtgcgctaagcctataggatgagtggatgaaagccggttggccctggggaccggtagggagaagccgtggcagagcacagtctctgcggagaggagggagacccaagctctcctggctgtggggaaggagaagccctgggagacacgggtaagggtcgggtgtcggagttaggacaggagcccctggtctgtgctgtagagaaggagtggaaccagctcccagtaagggtttccaaaggttaaatacttgacacctctgtctagaacagacatgacagacgaatcacgtgcctcccggtttgcagaaggcgagcgtgatgcagataaatcgtgcatctgtatcaggaactgcatatgtaagccagaattgctcgggtgagaacaaatgtgttcataaagattttccccaagtgtgtagcctgctcttcccttcaaaaccaccgttttcaagtaatttgtgtccttctcttataaaatcctcctgtctgcgtacttagactggaattacaacatgaatgctgggatgatctcccaggtaatgagatttcaagatgaagctgtcattgaacaagtgaacttgtctagacgaattaatcataatacgaatgaaactagagccacgggttcctgactcatagtccagggctcttgcagttgacaacgatctgcgtctgtcctatggctctgtctcttccctgaagtaggggtacatttggagggacatgtgtatggggatggagtcagaagtccagtgaggacttccacattgttgtcctaagagtaacagttactgtaagaaaggattcctaattggtcatttaacatcttatcacccagaaaagtaatggctgaaataaataattgatgcttgcataagtcagtaggtgaataaattagtcatttcaggttttcagatattgtggagatggaagtactgttgaatctgcctcccatacccctcgaacccgccggtcctcacctgtgtcaccctcgaccccgccggccctcacctgtgtcaccctcgaccccgccggtcctcacctgtgtcaccctcgaccccgccggtccccacctgtgtcaccctcgaccccgctggtcctcacctgtgtcaccctcgaccctgccggcccccacctgtgtcaccctcgaccccgccggccctcacctgtgtcaccctcgaacccgccggccctcacctgtgtcaccctcgaccctgccggtcctcacctgtgtcaccctcgaccccgccggtccccacctgtgtcaccctccaacccgccggtcctcacctgtgtcaccctcgaccccgccggccctcacctgtgtcaccctcgaccccgccggccctcacctgtgtcaccctccaacccgccggccctcacctgtgtcaccctcgaccccgccggccctcacctgtgtcaccctcgaccccgccggtcctcacctgtgtcaccctcgaccccgccggccctcacctgtgtcaccctcgaccccgccggtcctcacctgtgtcaccctcgacccccccggtcctcacctgtgtcaccctcgacccccccggtcctcacctgtgtcaccctcgaacccgccagccctcacctgtgtcaccctcgaccccgccggccctcacctgtgtcaccctcgaccccgccggtcctcacctgtgtcaccctcgacccccccggtcctcacctgtgtcaccctcgaccccgccggccctcacctgtgtcaccctcgaccccgccggtcctcacctgtgtcaccctcgaccccgccggccctcacctgtgtcaccctcgaacccgccggccctcacctgtgtcaccctcgaacccgccggccctcacctgtgtcacccctcgaacccgccagccctcacctgtgtcaccctcgaccccgccggccctcacctgtgtcaccctcgaacccgccggtcctcacctgtgtcaccctcgaccccgccggtcctcacctgtgtcaccctcgacccccccggtcctcacctgtgtcaccctcgacccccccggtcctcacctgtgtcaccctcgaccccgccggtcctcacctgtgtcaccctcgaccccgccggccctcacctgtgtcaccctcgaacccgccggtcctcacctgtgtcaccctcgaccccgccggccctcacctgtgtcaccctcgaccccgccggccctcacctgtgtcaccctccaacccgccggccctcacctgtgtcaccctcgaccccgccggccctcacctgtgtcaccctcgaccccgccggccctcacctgtgtcaccctggaacccgccggccctcacctgtgtcaccctggaacccgccagccctcacctgtgtcaccctcgaccccgccggtcctcacctgtgtcaccctcgaccccgccggccctcacctgtgtcaccctggaacccgccggccctcacctgtgtcaccctggaacccgccggccctcacctgtgtcaccctcgaccccgccggccctcacctgtgtcaccctggaacccgccggccctcacctgtgtcaccctggaacccgccggtcctcacctgtgtcaccctcgaacccgccggtcctcacctgtgtcaccctcgaacccgccggtcctcacctgtgtcaccctcgaccccgccggccctcacctgtgtcaccctccaacccgccggtcctcacctgtgtcaccctcgaccccgccggccctcacctgtgtcaccctcgaccccgccggtcctcacctgtgtcaccctccaacccgccggtcctcacctgtgtcaccctcgaccccgccggccctcacctgtgtcaccctcgaccccgccggccctcacctgtgtcaccctccaacccgccggtcctcacctgtgtcaccctcgaccccgccggccctcacctgtgtcaccctcgaccccgccggccctcacctgtgtcaccctcgaccccgccggccctcacctgtgtcaccctccaacccgccggtcctcacctgtgtcaccctcgaccccgccggccctcacctgtgtcaccctcgaccccgccggccctcacctgtgtcaccctcgaccccgccggtcctcacctgtgtcaccctcgaccccgccggccctcacctgtgtcaccctcgaacccgccggtcctcacctgtgtcaccctcgaccccgccggtcctcacctgtgtcaccctcgaccccgccggccctcacctgtgtcacccctcggggctgaaaccattttaagtgctcacctgggtgcctcctcagcctccaggggcctggcaggacttcccacccactctccatcctgcctgcaggacattcttgctaaaaaggcagcctgaccctaagcccgcccgaccaagagcctcgtctcggctctgtgcaagagccagaggagtgaagactgccgtcctctgtggggttgcaaaccccagtgacccggccccaccagacggcccagctgccctctcgctcccacccgctcccagccagtcttcctgaaattctcgcacctccatgcctctacggctgctgctcgtcggcccgcagtttcttccttgagtttctgcctgagtcctagctgtgctttaagccccagctcaggaatcatttcttcaaggaagcggcagagacgcgctcctgatctgatcagcgtctgcacgaagcacggcttctgctccttcccactccctgaccaggagctccagccacatagcacatttactgaaacaaacagaatctcgatgtacatttaaaatgtacttatcttttaaagacataaaaacattagatgccaaaatatctaggccatggcagagaattatgtttattatttgtatgccattacattgtctcaggaatatatttaaaatgtattgacaccatggcttttactctaacaggatgttcgtctaaaaagcattacattaaaaacaaattatttagattcataaaattaaaaatattctgaaaacattgagaaaaaaatacttttgctctcttagggaaaaaaaactagagtgatgcttttaaatgaaattacttgctgggcacagtggctcacgcctgtagtgccagcactttggaagggtcacttaaggccaggcattcaaggttagagagagctctgatggcaccacagcactctagcctgggtgacagcaagaccatgtctctaatgaatgaatcaaatgaatgaatcaaatgaatgaatcagatgaatgaatgaatgaaacagaatcattcaacatcagtacagaccacctttgacttaaagatggttggacttacaattttttaaccttataatagcgtgaaaatcatccacattctgtagaaaccatactctgagtgcccacacaaccattctgtttttcaccttcagtacagtgttccatgaattcgaggagatagtcaacacattataaaacaggcattaagtgagacgatgttggccaactgcaggccagtgtcagtgttatgagcttattaggagtaggctgggctaagttacgatgtttggtgggttaaatgtattaaacgtgtttcccacttacgatgtttttagtgtatgatgggtttgtggggacataatcccattgcaagttgaggagcatctgtatatttattttttccctgtaatgatgcaaaatatggactatatggagtcacatttgaaatatttaaaatgtgatcatgaagtcctatagatacatttgtgttggttgattatccagacaataatcttacaggtactatgtattaccttaaaaggttgtaatttatttgctacttttataacttgaaattttcttcctttgcttcatgggtttcaagagtcattgacatgatttaataggatatttttggacttaaacaaaattgcttcctgataggtattcctagatcccagagagttaaccttaaaaagatctttttcctgtgaagcatcacatggaaatgaaaggggagtggacgtcttgctcccaacacgtcatattccagccttgtctttcccgttcagtttgcgaatggttaggtgatgtttgccattggtggtggaggccgaataatgccgcacagttctctgtatgatagtgtgatggtggagttcatgtggcaacttgactgggccatggagtgcccagatatctggttaaacattattgtgggtgtgtctgagagggtgactctggatgaggttagcatttggaggggtggacgaggtgaagcagatgctttccccagtgtgggtgggccacgtcctatctagtggaagaaacaaaacagctgactcttccatagagagagggaattcctcctgcctttgaactgcgacttgcaccatgagcccgcccagatctccagcttgccactctccctgcagatctcggaactcgtcagcctcattgacgacaggagccaattccttatcctctttctctgtatgtattcacctgtgtctctattgtctgtctcttccttaccatctctctctatatgtgttcatctatatctctatcgtctgtccatccatcccacccatgttccattaattctgtttctctgaaaagccccaactaatatcatacccttaaagggtattttttcaggttctgtatttaaaatgatcagagaatttactaagagaattctcaccatcagctcttcacactggaaaacaatttgaaaattaaaaagctaggtcagaaacttcagtccttgtagctgtgttgggggaatgttcattaaaataaaggccgctgtctcagtgtcaatgtgctgtttgaaaacaggtgtcagaggcacagtctctgctgacaggtcgaggctggcactgctgggacaggtcactagttaggctggtgtgtcaggagtgaagggggccagagggcaaacggatcaaaatccccttctggaaaggagaacccaggtgggcttggaaagccagcgtcgaaaacttttgtcccttcttctaatcagcgtctgtcaccacagagaagtgatggaaaggccagagaagcgtcggaaaggccagggcacagggcagaggcagaggtgagcggacagtggaggaggatccaggacttcagcagacacagggctcaggctttggctcatctgacagcggtgccggggcatggaggccaccaccattgaaggcctgtggactgatggttccagggacagagtcctctgtgaatttccagcaggacactgcagtgagactagtgcagacagtcccccagctggttgctggatctggaactgaagtctccaagctagagtccatgaccccaggggaaccctagcgtaaggtattcatgaattcagggctgctcacagttagatgggataaaaagtgtgtctttatcctggctaacacggtgaaaccccatctctactaaacaaaacacaaaaaattagccaggcgtcgtggtgggtgcctgtagtcccagctactcaggaggctgaggcaggagaatggagtgaacccgggaggcagagcttgcagtgagccgagatcgcgccactgcactccagcctgggagacagagagagactctgtctcaaaaaaaaaaaaaaaaaaaaaaaaaaaaaaaaaaaaaagtgcatctttatcttcactaactttcactaacttgaatttacaatttccttccattatgaatgcagacagcagaacacattcctatgagattcatgctaacaatatcaagatagcttatcatcactgaagagttcttgcaatggtctggaaacaccaccctccccacgcttgaggctgcaggagctgccagtcccctgccgggtctctctctcattgcatgccggctgctataaggaagcgtcatagcctgcctggcttatgaaccccagagatttatctctcacagttatggaggctggaagtctggggtcagggtgtccagtgtgggcagcctccttgttcataggcagcagcttttccctgcgtcctcacatggtggaaaaagcgtaaggaagttccctaggatccctttataaaggcacgaatccctcatcctgcccccagacaatccacaaacccacggtcacagacgtcggtcatctcttccacatttcatgtcactgccatgcccaaggcctgtggcgataagccagatgagtttaaattaacccgtgcgtgtaccgtgccacaccaggctcaataaatattggttcaacgtatgagtgagtgatttgaaaatttacagttgataagctctttaattccttttctattgagagtttgtcctaacttagaggactctgacgtttaagttataaactccactgtgctcggctgttagccttggcatcgacttgagcctttttctgtagagttcctttctgaggacaatacttactcaggggcacccatgcatccttatcagatgttctatgtggacatgattcaattatctataaccgacatgtgcaagaaataacatttttttttaaatcaacttccattctaagttcccacccctcctgcgtggtgtactgtgaaattcagcctctgtcatttcaggttaaacccaaggcaataccaaaaccaggactcccaggaggtttggaggcatctgggaagcctcctggtcataggccattggtcccctcattggtcccctccggctgttatgagatccccaggtccccttctgcatgcaggattcgctcaagtctgcagaccttccctggggcatgatcaggacaggggccgtgttctgcagctgctcagagacccgcaggtccccttctctggctgtcatcattcccagcttccggcctctttcctcctctccctgagcccctggtcccctcagtcatgtctctactgagtacaggcttttgtgaaagtcatggtgatctttgccaatggagaggatatcgtggggttggcttcctcccatagaaatctctgaaaagaagaaccgctgatctcacttgaaatgggaagaattgtggggaaaacctacaaatcctatcacaaaggtttattctgcaacgtgagtggagtgcaggcgtttcccagatcggcagccaccacgaggtcatccttggatggcgtctgaacacatgtctggggagaggtccggaggggcccaaaaaatcattgcctgtgacgcttcaaaatttaactttattctccagaaaagtaaaaattatccaggtgtatacattgaatttgaataactgcctttacctaaagcttaagatgtccaaaagccaatgctatatatcaaaaatatttttaaactgaagcaaaaacccaaccagtaaattctttttgtttcttcaaagctaccagaacactcaatacccagtgtctaaattctttttgcttcttcaaagctaccagaatactcaatacccagtgtgtaaattctttttgcttcttcaaagctaccagaacactcaacacccagtgtctagtcattgctatttatattgtcagcagtggtgttggggtaaacagaatttatttaggccattttaatgttcccaaaattaaagcaagagattaaatgagaatgattactctgaattaatctttgaaccctttttcaaacaccaaaaatgcagagtgctagaaatttaactggcaagtttggtctatggttttaggtacttggatggtgagatctgtatcactactgatattttccaatgacatagaaggtggcaacaaaatatagtaaggaaatagttatataggaaggaaatatctatgaaggtaggaaaaatactcctttctaaaatatttaattatattggatttatttcatcctaacataggtattaagatagaggatcgtgctgtgctttttaaacgtaagtcatgggaaagctttgaaaatcccagtggattcatcatggggaatatttgtatctctatttatttatttatttggttttggaagccaggaaggaaagaaataaagaatggaatgatggatcatatcaaatgttaccatgagtacaaggaagataaagaaaaagaaaaagattcattagctaaggcagctgaaagatcatggttgacataggcaactgcagattcatggaatttctggagaaaaagccccacaccttaaatatgcgggcaggttacatttccaagtctttcagtggcaggatatgctcctactctctttctgtaataaaaacgagtatttcttgtatccatttattggtttacagcaggtcattactttataaccatttcgatcaattacacaatcaattgaacaaactcacaaatatgtatttggtacctgatgtgtataagataatggagaggtactttataaaaggaaaggaaacagaattggaaatagatttagaagctccatatacatgaagagataatcatgttcaaaaacttttgtcccttcttcttatcagtgttggatgattataaactgtcctatgattcataaaatagtcaaaattgctgtctcttctaaatattgacagcataagcttagatcttgatgtaattataaggcacaggagtggtctctcacacgcttattctgtgtgtgcgataaaacggaggttttatctgtgagggtattctaaaacacccgtgttatctggcagatggcgcttaacagaaatgaattatttgtcctcttcggctattccagaaaaagatactgggtgcttttcaaaagatcctcagaatctgcatctgcatttcttgaccaagaagacagaagcttgggtgacagttgctggagcagagatgggaggagagtagacacagaagcttgggtgacagttgctggagcagaggtgggaggagagtagacacagaagcttgggtggcagttgctggagcagaggtgggaggagagtagacacagaagcttgggtgacagttgctggagcagagatgggaggagagtagacacagaagcttgggtgacagttgctggagcagagatgggaggagagtagagacagaagcttgggtgacagttgctggagcagagatgggaggacggtacggacattcctgccattgctgctgcttctcatgtctgcctccagcatctaccaccaagaaaacccctgctcagcggaattttgggattacatggggaataatatggggaactgtgctaacagatacgtgtatgcactttctcaaacgtaccatccagcgtccacattctgaagataaacaggtttaccaattctttgcaaacactcagacaccgtatttcttcctccccacctctgcctcacagcagaagggccaggactgaagcaagagccacacacatatgtggctggaaatgttgacccaccagattctgtgtgttctgtgtggcccttcttcacagggtgccctgagcccaaccgaatgaagcgctggccccgtcagcagccatggtcacgtccacttggaagttccaaatcccgaggttcctgcagagagcagctctctgctgtggcaccagctgctggtgagggatccagctcccctagttacctcccccatcaccaagagactggaagttcctggcatacaacataggctgagatcctcaactgagctgcttctctaaagcaggggcagcgggcatagctccagcacatggcggctggggcgtccatcccttctggaatatgccctgccatgaccaccccactcctgccgggctcctgcctggcccacagctccaatggcttaagcccctagctccgttctctgcgttcacaaaaccaccacaggctgtgtagccctccccatgtgaaataacaggggaagatgtctgacttacaaggcaactgccaggcagcaaaaatccttctgatcgtattttccatctgggtatgtgctcatcagaagtaaatttgaaaagttaaaaaaaaacgaagtgatggagggacacagtcttgtgtgtgaccacccgaggcaagccccgcctgcacctctggtcagacattcctcagcgccagccagcctttgcatgaggcagcactcagagcctcgtcagagccgggctgggcaggcagcctgccccaggcacctacacagctcgtttctgcaagccccacttgcccagtgaggctttctctttttccttgagaattaagttggtttttttctggtcatacactctttaacatgcaggtgtagaattaagagatatttgtgtttctttcctaaatgattccataaacctggtgctaaggaactattacattagacccttggtgtaggcagcaaaggagattgggctttacgcacaccgaggttcttacgtgaagatgctaatgacattcctcctggagtgtgtgtgagcccaccacgttcctcatcctgttatgtatattttagtaatccattccattcattgtgagtctctcccctggctagaatataagttccacaggggccgggttttcctcgctgctgaattcccgtgcctagaacagtgcttggcacatagtagatagaaatgtttgttgatttatttagtgaaaaaaaggaataaatgaatgaataagaaggattctctctctgtgtgaactactaccttagcactgctgcccacttgcaactaaccctggtcttgtgcgtgatatttctgagtttccaggagagcagagacaaggtagagaataaaaccctctgtcaggtcaacgacacctaggaagtggtaggcggtccgtagatttttggggacatgtacatggatgaatcagtcctttctgtgcacttatgtaaaacttattttcattccttatggaatttgcatcgtctgtttctgtcattcttgaagtcagggtcagatctttattttaaaataaagaataacatgcgagacagacagtaatgagaccagctggcgaaccaaaatgttatgagcagtttctgaaaagcaaagtaaattgcctccttggtctatgtatcatcccatcagcgttcgtatctcaaggctgtgccacagatgactcattgtgcaattatcttgccagcctctccggtccatatgccctttgccttgggcccatgagagtcgcaatttcctggtgacccagaggactgtcatgggcctttctctattttgttagaagctcttcattttcagggtaccactgtaaatgggggatttgaaacacatctatttcgacgattaggatgaagaaggagtgcccagttgctgccaggcctggagatactgtggcatcgcgttggttcttagtgctggccctgtgggtggggtagggagccgacaatcctcaccacgcagatgctgccaggcctggagacacgggcagcacgttggttcttggtgcctggagacactggcattgcattggttcttggtgctggccctgcgggtggggtagggagccgacaatcctcaccccgctcacggggaggctgcaggtgcctggggtcatagggcttcctgtggcggggccagaaccgagcccgggtatcccgtggccatcccacaccctcactgctctcaaggctgccggcttcctggccccacaggtgtcgttcatgctcagctagctcaaactgatgcttactgatccacataggctctggaggttcacagagcaacttcagtgcaaggagccctgatttattggcaggaccaacggcagccctctgatgggtccgtctctcagatccgtgggcagagggcaagtcaggatgtttgggctgtaaattgcaggggtggattcctgtatttgcttgggctgtgaactgcaggggcggactcctgtatttgcttgggctgtgaactgcaggggcggactcctgtatttccttttccattagggtcaccttaagattgagattatgacatccatagtgtgggtttgggaccttccaaccttctgatcaagctttatgggagacgttgacatgatttaggatatattcatttgactctgaggtgtaagtcagaggtaacacggtcttaactcttgtcagttgcctttgctttattgttttattaattttttaattgaaggtcacttccttatccttagaaagagagacattagtaacttcaggtatgttagttgacggatcaatgtctgcgcactcactatttgccatgtgcatggtaaaaataaactctcatcatcaaataaaataccacctacagaattagccctcccttgaaatcttggtagtaaagatttcattctgatacaacttcagtatagatgtcattcacaattaggtgtcccgtgtacgcacatgcacatatggagagacacactgactgtgaagatgtgtaacaaatgctacctcctgtacagttcacagcatctcaaaaaacaggcccaccagcatcctccagttcttggtctcttcatttttccactggaaaaattattcctttcaaacatgttttcatctaagaagctttgcattcttaaagaattggaacatggccgggcatggtggctcacgcctgtaatctcagcactttgggaggcagaggcgggtggatcacctgaggttgggagttcgagaccaccctggccaacatggtgaaaccccatctctactaaagatacaaaattagccaggcatggtggcaagcgcctgtactcccagctactcgggagactgaggcaggagaattacttgaacccgggaggcggaggttgcagtgagctgcgatcacgccattgcactccagcctgggtgacaagagtgaaactccgtctcaaaaaaaaaaaaaaaaaagaattggaacataattgtgtcctacttatcaattggattgggaaggagccaaactatgttgctgatatgtttctgttttttgtgtgtgttgatgtcaaatcatcctaaaagtcagtgtgcgccatcactgatgatgcattccttttctgggttatcctttagttttgttacctggccctttgaacattcaaaattctgtacttagaaacatgtgactcttccgttcactaaacgttgatgcattctcagtgttcttcagaaaatacaagttctcgccgtgtgatgtgatgttcaaaccttttcaatggaaacaggaagtgtctcgaacagcagagcagctgacatcacttcattttactgtctacatgttaaatgctggtgagactataatttcttgctaattaacacattcaaaatagacatctttgctgctagcctatcaacgttgccccagaacttgtgggacccacataatttcttgtaacttcaggaaaaccattgtgtgtatgcttgtgggatgtgacttctgtgtcctgtctgatttattcttctgttttgtgactagcattaattaaagtgtcaaaatggctttgatcctctatgttgaatcttttgccttgaaagtttagtttgtccaatattcattctctcattcagacagtcatgggcttgatgactgtaattccttttatgctatcatccttgaagttctaattaagagagtgcaatgaatgcaagtgtggctgttacattcaaatagaatggcaatgcttgccattcaagggatattttatcttgattacgtatttgtgccttatacgatggaatgctaattttcaaattcccgtttggtttgcaaatgactttcaagcattgaattcagaagtggtgtccagaattccaggtgtagaaggataattaaacatgtgtttaaagcgatgatggattcacatttgcgattcctcaaagccatgtgaagtgtagattgtggagcagtttctttcatctcattcacacgagcttctttccagtaaaatgctttggtccaaaatctcctccacgaggttggctaacccaacaccttgaagacctgaaggaccttcatgatcagagtcctctgcttcatgtgctgtgttagaacactcagggaactatgtccagacatggcctcttcatgcaggacatgtcctagacagcgctgccagcacagccgtcatgatgaggaagacgttccacgcttaggcaggccagcgtggtagctgctggccgcacctgaccatgaccagtggacacacagcgtgtgccgcagaggaacccaagtgtaatggtattttaggtgttcagatattttagaatattggaggccaggtgtggcatctcacagctgtaatcccagcactttgggaggccaaggcgggcagatcacctgaggttgggagtttgagaccagcctgtccaacatggtgaaaccccatctttactaaaaatataaaattagccaggcgtggtaccgcgtgctacttgggaggctgaggctggagaattgcttgaacccgggaggcggagattgcagtgagctgagatcgtgccactgcattccagcctgggtgacagggcaagactctgtctcaaaaaaaaaaaaaagtttgagccatttgttgtggccagtagctaagttattggtcagggcagtctagaaaggagcctttctgacacaactgtggtaaacctaagaatgtaggcattttcaatgggtagcagtctcccaccccttcactctgccaacactgcagccaccactgcgtatttgtcaattgtgccatctccccttctgacagtccttttgactccagatatttgggcaattttttcagaaggggtttgcaaatgaggtgggctcaattccagatacatctgaggaaagtcagtttttacacacctcttccctgccccatttattcagctctaacagggagggacccatccacctgaatacatttcctttaagcatcaacactcttcatttcatgcaatttttatggaattcttcctaaaacttactatatgtgtggctctctccatcctaagtagtgtgattaaccttttcttcgtgccccaagtcattccattggcctcagagtactcaagaggcaaagcatgttacacagttccttctgatcacaaccccattattctcagagtgacaccaacttatgcgatccctgtgaaacaaacaaaatccaaaccaattcagtaattgaattacaaagcccaggtatgttttcatctatttccctgtaatttggaagacacttaaaaaaaatcatcagggattttatagtgttgtttacatggtaaaagaaaccaatgctaggctttaaaaaccaaacagatactcatgcttggaataggtattttttttttaaagaaagtagtcaggtcaggtcttcagaaactttcagttattaaacaatcatttcttcttctaatttcaaaatacatatttgatcacttatataatcccatgtggttgtttagtaatctctgtctctgtcttgattcatcttctttttaaggacgtagactagaattacattgctaaattaaattttgaattttcaaatacatttaatgtttgacatacatatagaaagtgatagataacacagcctatagctcataaggattagttgtgataaacgcatgctaggcgtgcactcacagaaacagaatgaagacgattattatcacccacaccatccaactgaatggctggatatttttctctaatgtgtaaaatgctttcattcattgattttaatctgtggcagcaaattaatgtggtcaaatgatcattttgaattctttctttactattgtttcccagcctccaattttaactttaatgagccatgtagagatttacaattctatcacacagggctgtacaggcacaacaaatgtttgtcaaaagaatggattaatgaatgaatggatgcagtgatatacttccatgtttcagaaatcatttcttaatgttaatctctatatcaaaatcattttatgtactgcaatttttatttaaccaggacaactgataatttttaaaatatagaaatcaaatattgccaatataaggaaaatataagtgaaacagcttcgttgtctggggtataaaccctggtccttttgtcacagccgagaaagaatttacgacatggacacatggttttagggggcgaaaagtttaatagaaaaagaagtgagagagaaaagacttccttatgctgagggagcagatcgcccaaaagaaagtctcccgtttgcagcagaatgcaatcggttctgtacagaggcttgaggaggtggtgattggcttacatagggcccaggggattggttagaccagatgtgacatttacatagttcgcaaaaagactggccctcccaccctcgtcttttattatgcaaatgagggctccaccctccacctggctggttgccatgatacctgtatacctggctttacctggaggctgccatgacaccctgcacatactgacaagcaaaagcgagcaggagatgccatattgaatgtacctggcttccaggtacagctgctccatttacatatgaaagctcctagtctgcatatctatgcctgacttcttaggcagctttcccttaaagaagaaacggtttaggggctacttttttatatatatactttaagttctgggatacatgtgcagaacgtgcagttttgttacgtaggctatggatccgtctggtcctgggctttttttggttggtaggctattaattactgcctatttcagaacttgttattgctctattcagggattccacttattcctgtgttagtcatgggagggtgtatgtgtccaggaatttatccattcccttctagattttctagtttatctgcatagcggtgtttatagtattctctgatggtagtttgtatttctgtgggatcagtggtgatatcccccttaacatattttattgtgtctatttgattcttctctcttcgcttctttattagtctggctaccggtccatgtattttgttgatcttttcctggattcattgatgtttggaaggtttttttgtgtctctatctccttcagttctgctgtgatcttagttatttcttgtcttctgctagcttttgagtttgtttgatcttgctactctagttcttttaattgtgatgttagggtgtcaattttagatcttttctgctttcttctgtgacaattttgtgctgtaaatttccctctaaacactgtgttagctgtgtcccagaaactctgtgtcccagagattgtgggacacagctaaagcattggtttcaaataacttatttatttctgccttaatttcgttatttacccagtagtcattcaggagcagattgttcagtttccatgtagttgtgcggttttgagtgagtttcttaatcctgagttctaatttgattgcactgtggtcggagagactgtttgttatgatttccatccttttgcatttgctgaggtgtgttttacttttaattatgtgtttgattttagagtaagtgtgatgtggtgctgagaagaatgggatattctgctgatttggggtagagagttctgtagatgtctattaggtccacttggtccagagctgagttcaagtcctgaatatccttgttaattttctgtctcattgatctgtctaatattgacagtgggatgttaaagtctcccactattattgtgtgggagtctaagtctctttataggtctctaagaacttgctttatgaatctgggtgctcctgtattgggtgtgtatatatttaggatagttagctcttcttgttgcattgattcctttacctttaggcaatgcccttctttgtctttttttatctttgttggcttaaagtctgttttatcagagagtaggagtgcaactcctgctattttttgctttccatttgcttggttaatattcctccatccctttactttgagcctatgtgtgtctttgcacatgagatgggtctcctgaatatagcacactgatgggtcttgactctttatccagtttgccattctgtgtcttttaactggggcatttagcctgtttacatttaaagttaatattgttatgtgtgaattagatcctatcattatgatgatagctggttattttgcccgttagttgatgtagtttcttcatagtgtcaatggtctttacaatttggcatgtttttgcagtggctggtaccagtttttcctttccatgtttagtggttcattcgggagctcttataaggcaggcctggtggtgacaaaaagctctcagcatctgcttgtctgtaaaggattttatttctccttcacttatttagtttgtttagtttggttgcctgtgaaattctggttgaaaattctttaagaatgttgaatattggcccccactctcttctggcttgtaggatttctactgagagatctgctgttagtctcatgggcttccctttgtgtgtaacctgacctttctctctggctggagggctgcttttcattaaaggaaaattctactaagatctttcaccttttctagctgcctaaaaataatttcttaataactgctgtattatttgtaacttattgttctgctataaacaatccattcagaatgcatgagggattatattatatgcatatacgcccactgtaagtgagaatgacaaaagctatatttaaaatatattttaagtgcctgtccctggtcttcacacacagatcccccttgacctctgtactcacatgtaaaaatgcgtctggtatctgcatacctggaagtttttatgtgtattgctaaatgtttctttaacttctacagtgtttccaattctttaaacgctacaggtcagttatttctattaaaactatgtgttggatttctcatggggtcattaacaaagggacttacatggacaagtgattaatatttttaggggattaaaaatatcctaccaggacacatattccctcctgcagagatggcgtttcagatcctgtggttggtaaaccctcagatgatcaatcaaaactttcccttggtcctttagctaaatggcccaattgtttttgagagaacctgaagttctgataacatagtgggcttttccccttgaatggtgtcaccgaagaatacacggcaccgtgattccgtagctaataccgcaactttcagcaacaaggctgctggaaccggaatcttgcacttcctgtctacgagacagggagaaacttcacctgtttctgctggcaagggttgggggaggctaggggacaaatccatgtaaagacagcagtgactggcagttcacaagtgttcaagctctagctctttccaagaaaacgttgtctaaatagaaatccttttcaaagcctttcaagctggttttcttcctgttcacgttggagccccaggagagctctcattctcagcctgctgggcccagcttctcctcatcccgctgaggtgctgcgcctcatggtggtgggggctgcagacctgtgtggtgcatgaccacctgttctccatggcctctactatgttgacatggccagtaggagcactgagaagaggcagggagtaacatcactgttgacaaaaggccagaagctgggtctaagttctgctgcttactgcacagaaagccaatcactgagacagcgagtattgccagggaagaaggctttcatcagatgctgcaggaaaggacatgggagatccatctcaaatccatctccctggcaaactaaaattagaggtttatatagcagggaagaaatgtaaccatgtatgggaaaacagaaatgagggagctgtgaggaagaggcggccaccaggaagcagatgatgggttgggcagtcagagtggatgtgaggtctttggtctcattgtctagatgcagtgatctggtgaattggagctccatgatgctatctgggaggcctgatggctgctgtccttagaaaggaactcagataagacagatgtaactttctcaggtttcaagactaggagggtcagtttctatgtttatctaaagaaacccataaacatccgccctatgggacaattcagccggtgtcatcaccatcactcagctgaaacagagagccagatctcctgcaaagcccgctgctcacagtatggtgagcctgggtgctctgccagagcaagaccacaggggaagaacacggtcacgctccttacagtatggtgagcctgtgtgctgtgccacagcaagacctcaggggaagtacacagtcacagtcacagggctgccgcaaagggtcttccgcccataggtcatgagggatgaactgatgctttggaaatcagtgggtcccacacacctttcctatgaaccaggaaaatatatcatcaagccaataaacaaatattcgaaggcctctttcccaaaataattttcattgatttggtatgatttaaggaattgaaagcccatttcatataatctcctcttactctggcttaagcccattagttaatagtccctttaaacagtttgggtcatggagtgtcagggtataatctttaaaatatcttctgccaccaaaggcattttgattttttgtttttaggaaacctggaaccgccataaatcttgctgaaataagtgcctctttcattgaattttgcagtgggcaaggattctgacgtgcactcttggacccgtctcttaaatgagaaaacactagatcaggtcatgagaaataaggttctgctatgtaaatggtcacaaaaaagaaaactagactcattataaccaacaactggagaagcatctgaatctcagttctaccatttttcttgtgggctgatgtcaggaagaggtttaagcccattcagacttccaccttctcttccaagatatgcaaatgccaagaccgcctaccccacaaggttgttctgaagcttaatgaactgcaaagtataacgtgctccacagagtgcctggcacatgtgtgagtgtggggtgtgtgtgtacacacgtgtgagtgtgggctgtgagtgtgtgcatacatgtgtgagtgtggggaatgtgtgcctgtgtgtacacgtgtgagtgtggggtgtgtgcgcgtgtgtacatgtgtgagtgtgggggatgcatgtctgtgtgtacacgtagtgtggggtgtgtgtgtgtacacatgtgtgagtgtggggtatgactgtgtgtgtacatgtgtgagtgtggggtgtgtgtgtgtgtatacctgtgtgagtgtgggggatgtgtgcctgtgtgtacacatagtgtggggtgtgtgtgcgtttgtacatgtgtgtgggggatgtgtgcctgtgtgtacacagtgtggggggtgtgtgtgtgtatgtgtgagtgtgggggatgtgtgcctgtgtgtacacgtgtgagtgtggggtatgactgtgtgtgtgtacacgtgtgagtgtggggtgtgagtgtgtgtgtacatgcacatgcgcactccaaggtgacttttctttctcatactgaagaaatgaaggggtggtggcaagtttgcagctgctgctggcattttcttctctcctttgatggtggagtcggccagtgctgtttggggacccggtggtgacagcgcccttactgtgcacccgtcttcgccagcttctctggatgcttatctccgcttcgtgggacgccggacaccgcagagcaccctcagacagagggaaggcagtttctccaagatcacatgatgacatgctttcatgtctgaagcaagaaagattgatttaatagaaccagaaagaagtgtgtgagatttccctgtccacagattttgcaggaaaggaccgagaagcccccctttcccttgcgccctgagcgtaatggttaacttcgactcacaggggaggtttggtctgacagctgtgacttgcctgtgagtctgtggatcctgtaagtgaaactcaactgcagggagtggtaaaaatcatctcaagatattaaatcaccagaggaaagcagagcaaaacaagcgttccagcatcacagcgcatgttttgatttagaggaagagagaacggcagaatggtcatttgctgtttctgccagaaggtaaatagtttgaggaaaactccatgacgcttgtaaagaaaagaagaagtcaggccgtatccccagagcactaatgtgaccagtcggttcagcccccagaggagcctgcagaccgctggggaaatccaagtaaagtttgcagtatccttatgccagagaatagtggttttgttgatgacaactgatccactgataccaaaccctcctccaccagggctgcctttctagagctgaggctgtgggtgcgggcacagcagcatcagcatttctgtaggacaggccatgcccactggccttcccgtggcagcgttggtgcatctacaggacaggccgtgtcacctggcccttcctgtggtggcatcggtgcgtctacaacacaggccacgtctactagcccttcccgtggtggcatgggtacatctaggcacaggctatgtccgctggcccgtcctactcctgcttcccaggagcagctccatccatctcaaggcacggccaggctcacccccaggaagcttctttcaaccccagtctctctctgggcatccctagtctctgatgctgcacccttggttctcaggacggccttttcagtgtgattatggagcacactggggccaggctcttaggctctagataaatgcttcctgaaatcagcgaatcttacaatgttgtatccaccagtgaagcttgccaggcactttacgtcggtgcccaacgtggaagaaagcccagggtcttcagcccccttatcaatggtctctggaaaacccatatggtaacagcaaccatatggacattcagttcgacctggacattcagttcaatattgcagccttgctgataacggtgaaaaacaatactctttcacaaagttccaaccacaacttttacgaaagtcagtcagtgataatccctgtatcactgcagcacagctaattgcttcaaaccacgttttcgttttagtggttttgagaacaacctggcaggcatgtgcacacacacttagaaagagcatcatgtctttcttttgtcatccaggaaaaatcactgtgtgtgccctgccaggtagagtgtagtaaattcttctttttgtacgctggaggtgaactgctccttcttaatctgtttgttttaaaagtgtggcatgcaactacatttttacaaagaaatcagtttaaaaaatcatttcatcagcctgtagcaaacacattataaagtgagaagatgtggtatgtgactttcctgtgatcatggagataagtcataagctgccccatacattttttttaatttacgagatattccatacaagaaggaaggtttacttgttttgtgaaatttttcagactctttaaattttacttaaatacacttagtgaggtctgtgattttgaacagtggcgacagacctttgagagtaactatgaaacacataatgagccaaggtggggatgaatttgcatgcatttgctcaaattttctgggcaggtcactaactgattacttcctccctgttgcatttgcctgtgacatgttgtgacatggttatgacgcttgatatgtgccatcgttcactgcttaggtgaacctcgctgggaaaatccaaccaatttggcgtgtttaatatcacctttctgctcatctcaaacttgccaaagaaaaatataataaggcagatgtcacattttaatctatattcccgcgtctctctgttgcctttgattttttactacccctattgctgggactcaaaacttcttcggaatcaatatttctgcttaagagaagcaacgcagagccagctttgccactggagaggtcattgagagcccccgtccgcagtctcgctccagcgcgcagcggacaccgggcctgccttcggccagagccgtagaatctgaagacgtgtcattgatgataaagattctgttttctgtaaatgacccatgacaaatgggttaccatgaaaacagccgcctactctccagggctgtcacgtggaaacccctttatcgatgagccctcctcacatctccacccgcgggctctctgaccatgtgtccatgtcgcactcaacacccttgataaatcagcgctgtgaaacactgccaggaaaggcgtcatcagaagcaagtgtttaaacggacctcatccctgccaaggtgagatgaatgtgcagtccccaacgcgtcccacccggaaaaacgaaatatttcctaacccaggtctctccccggcactactggcctttgggatggagaagtcttgggaactttctgagtctcctaaatagtgccttgaatcttgtcagttttcaataattttgcttaaggcattgattgacgttagagggaaaagtcaggaacaaaagaaaaaaagacaggattttgaatgtttgtctggtaaaagagaagctcagcacccgattgatttcataacatctgatcatccttcctcagttttctaggcttcagattctctttccaatgcatgctttttacaaatgtatccactttgggctggatgtggtggctcacacctgtaatcccagtactttgggagaccgaggtgggtggatcatctgaggtcctgaggtcaggagtttgagaccaggctggcccacatggtgaaaccctgtctctattaaaaatacaaaatttagccaggtgtggtggcaagcgctgtaatcccagctactcgggaggcagaggcaggagaatcgcttgaacacaggaggcagaggctgcagtgagctcagatcgccccactgcactccagcctgggcaacagagaaagactccatctcaaaaaaaaaaaaaagtctccactttgtaaatgttaatatgtaacattatgccttaaagcacaggtcatcctgaatggcaggcttgttttgtcgtttgtccttgttaactcgggatgacattagaggtcagagtggattaggaaaatccactcatgggttaaaaatgattggaggaggtgagggatgggaagtgtcctgcagacacagaaaggatgtgtttccacctgcagcagccggcagctgctctcgggcaccgtgtctggacatccttggggaaaactgctgctcggtctgtcctcacagacggcgctcagacccctccaggagacgcccacgtgcgcactcacctacgtcacaagcagcctggcagtgcctcccactgtgtgtgtgtggcaggggtggggtggtggttgctttgcactctgatgaggggagcagattcccttcaagaagcacttttatcagctcttcctgtgcactaaaggaaaataattgactgtaacggacaaccaattcctgttgagggagagtgttagggagttcatcctctctataaaaataagttatagcctgagtccaggccaaggtgcctcatgcatttttggtaggttctaagagttatttaatacagtcatcatctccggatgcatttattttgctttggtggcctgtccagctgtacagccggtggtacagaatgccccatgcaactcgagtttgggaggagactggctggtgacggccacaggtgagcgtggcctggcccagctcagatgcatagagctggcccctttccggtggtcttcctacaacttaaacctatggagcctgtacttatagggaagcaagtaagtttctgctattatatattttctccgttacagaaacagtagctattcgttataatgatttttagaaaaacacacaagcccaagagcagacagtgcccatcctgtcactcaacagccgcgattaacatcttcaggtgctggtgacctcttctcacacacaggtttcctgtacaaatagattccatcttgacctatgcatagtttagcatccggcgtgcttctgaacctagtgtgatagaatcagcattttccacgatgacatgacctgcgtagaaatgacgccatgcctgtgcgctgtcctgcggggacacaccttgcctagctgtgtctctgctgctgggtttgctggtatttttaaatgatgccatgcctgtgcgctgtcctgcggggacacaccttgcctaggtgtgtctccgctgctggatttgttggtatttttaaatgacgccacacctgcgcactgtcctgaggggacgcacgttgcctagctgtgtctctgctgctggatttgtcggtatttttaaatgatgccacgcctgcgtgctgtcctgcagggacgcaccttgcttagctgtgtctctgcagctgggtttgctggtatttttataatcctgcactgttacaggtatattcatgtgtgctgtctcactgtcccctcatttcacgctatttttttaggctagacgtccaggaacagacttgctccgtcaaccacagggcatgggcgtggggaaacagtagaccacaggctgacggggaagaacacgcctgttgacttgggactttcttttcttacagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtagctgctcttggccgcccgtcagggcctcgctccactcagtcctgccaatagcctagaataagccaaaacccaaccagcggccctgggtccttagcactgactgtaaccccagcagggctgtggaatctgagagcagggctgtgcgttcgccttgcagacctgccagcgcagtgagtaggtgggagacccccgaggtgatgcggaccccagtgcagggctgaaggaaacccaggggttccagctccctgtcccctgccaccctgaaaatacactccgggccacttgttttccaagggccaaaggctgcctagagagtatggagataacactgttttgatgctttaaaggggagggtttctgttgaagtctgatttttcaaaagcttttcggtattgtggccaaagaattgagtggggaaaccaaaaggtgctgggaatgaagaggtaaaaggaagggcatgctctcctctctacagaaattggacgtgctcacagcaacttcaggtgctggcaggcccctcagctggggtcacagatgttgcatccatggtttcagaccacagacggttgacccgccgtccatctgggcccccagatgtctacccatgatatagacgtggcagacggttcctttccccgtgaatggagagctctggccggctcctgcccacgctgcacctccctctgcaagtctgttttaggtgcagtgttgtgcacccagggaggccgggagattgtcctgtgatctgggtcaggtagcgcatccctccgggatctggcggacgtggttgagcagggctggccgtcaagccctctgccaacacggcccacctcctgcttccttttaccccttcattcagcctgcgttcctcggagctttaacagtcagattcttgattgccgctggggcggcccagggaggagggtgagtggagcgtgctgagagccgggcccgtgcggcgctggtagctaggcatgcgggcggagagagcaggggagccgcccgctggtccagggcctccgaaccaggtctccacactgtggcttcattgttttgtttaggattctgaattcccagagcatcagccatacccaaggtcagatgtaagtaccgaaatgtgctccaaagccgcgtccgcatgactttcattttctctcccttttttggatgttcatgcgaccgctcttgtcgcctctgtcctgattctatgtgccaggcactatgctgggtgctcccatctgtcccccttagatgaggacaaggggctcaccagggtccctaacctgcctgcagccctgggcctcgctgggctccggcgccggtaagcaggaaagctagggtgccatcgcccgtctccgtctccgtctccagggtcacgtctgcagtagagactggagaggcccccaaattagccaggtgacttcccattgccagacactcccaccctctctcttttctcctcagccacctcccacaggtgccctccaggatatccacccagccacgactgaggcagtgccaacttctaagcacgtgcagtaccgactttatctgaaatgagtgggacataattttggaaactcatacagttaagtcagcacgctcggcacagtgccgccgcttcctgccccgcccacagccaggaccccacacccctccgtggtcagccctcttccgctcccagctcccacccctggcatggcagcctctgctgagtacaggcttctcctcatccccccagcttcccctgcaaagctcagcctgtgcctttaccccttcccggaggcctctctggaccccagccccacacactgtgtcctgtgagagggaactgcacccccagcctgttgccaccctgcacccagcactgtgcctggcacatagggagtgctcagtaaatgttgggtaagcgagtggacggatgggtcgctgggtgcgtgctgggtgaggatggatgcaaagacaggaatgtaggtggatgacgaagtcacctttcatggcagtaagaaaaaaaaacgcacaacatcctgtgtgttttctgtgcatcctgtgagctggcggtctcacaattatccaaaggaagtgaattgaaaagctacagagaaaatgtagttggagcagctccagtgtcaggataaggaaaacagccaaagaattgaagccactgcaggagtaaaggggaggaaaagaaggaatcgagcagatgaaagacgggttccttctttcagggaggcgtcaggaggggagctgcagacggcagccttgccagggcaggaggtgacaggctgggacaagagtgagcaggctgtggacaggtggccacgtccctgccaggcaccatttaatccttacaataaccctgtgtgctggttgttaattgtgcccagactatggatgggaaaactgaggctcagggagggtcagtgacttgcctaagggctcacggccaaggccatgagtgaaggcagcggccgagactggagcctgcactccactccacccctctctgctctgcttctcaaagaggagaaaatcccagaatgattccgtgccctcaggagcctgccctggttctgttcctgttctgggacacagggcaggtgtcacgctgttctgcagctcatagacaaagctggctagcccgtgttccaccagcattcaatgggactggcttccgggacctttgggcacagttttgtctgagtgcagatagcaggagaatctgtgttctgcgaatgtcattcctacaaatgaacagcgtccacgtcactgaacacatcttctgtggagctcacgccctctgtgagtcactggctcatggagagacagctccaggagggtcctgtcccggggtggggggtcctgtcccacaatgcaactcccttgttcacagtgcattgcatgaccttttactatcagggtttgaattcaggattctcattataattactgggctacgtctaacgtgatccctaatgagtgagggtcctcagctcacacctcctatggcccccgtcctccttccctgcccagcttagagcagaagccagcggcaagtcccctgttcctcagatgtctggccccggccacctgagtctggcccttacagcaggactcacagacaggtctcatcacagctccagatttgcaggccagatgcccgtaggagagaatgggctccagccttggcactcataggccagtcctaggataaggaggagagcttgtgggcatggctgagctacctcggagacgtcctctgacccggtctggcctgacctcgcttttcttcattccaattggaccatttgtgtattcactttcgtttttatcctttgcggtttgtctctcctgctaagttttccattctcttttgtgtgcatgtgtgtgtttggggaactctgggaaatgtttacagctcccagatactgcggttaggagggacggaggcctggtctaacattcagggtccttctgtccctggtgccttgtgaatcccacctttataaatgagatcagtttttttgttgttgttttttatttttaattttttttttttttttgagatggagtctcactctgttgcccaggctgaagtgcgtggcacgatctcaggtcactgcagcctccgcctccacctcctgagttcaaatgattctcctgcctcagcctcccgagcagctgggattacagacatgtgccaccacgcctaatttttgtatttttagtagagatggggtttcaccatgttagccaggctgctctcaaactcctgacctcaggtgatccacctgtctcagcctccccaagtgctgggattacaggcatgagcctccatgcccagccaaggagatcagtttctattctgtgatctcaccaggttgtgagaaggcaggggcagcctggaaaagactctgcggctgtccattctgaatgtcctgcctgtgataaaagtgtctgcctgattctccaggcacacaggcagctgctcttcctcatggctgccccagagctccaagcctcacaggcagctgctcttcctcatggctgccccagagctcaaagcctcacaggcagggccggccactcacctgtagctctgggaggcagagcacgtctcagagggaaataaacaggagtttgcatcagattcagggcacctgccctgctatgtgtgaggtgttgaaggaagagcggaaaatgagcttgttgggagagcaaagattacagattggcaccctggcccagtattactagtgagcggttcctgctgccagccccgcccactttcattttctcagcagccctacagaagctgggctcagaggaggctggttggctttgacgccgctgctagcctgggactgcatgggaggtgggacagtgattttgctcattcatctttttttcttgcacccatatatttttcaaaactttaagagatgagggcttgctgtgttgcccaggctggagtgcagtggtgcaatcaatcacagctcactccagcctcaaactcgtgggctcaagtgatcctaccccctcagccttgcagagcactgggattatagatgtgagccagtgtgctcccactgcaattctagtcagaatttcctttggaaaagactcttgagttacctttccattgtataaaataatttattttctttgtcccagacttgcttttctgtctcacatgaagcctctctatgcccaggatttctgaaattgataaatacttagctcctcctggccaagtatgattttaccatgtccccttcagactttaccatccagcaatggagaacttcattttacttagaaagatttcataaaagacagccagggtaaaatctgcacagttcatcatatgcgtgtgcctttaatgtaatatacataccactattcacgtgaccgtccttaaagctgggatgagagaacagggaatttgcatttgctgtggacgaacctacttgagtcaggcctcaggctgagagttttacatcagttaactgaggcattgggtgtcccctctttgaaacaaggaagcaaagattcaacaaaatttaaaagagtttcctaagagttgcatggccagcaagtagcagaatctgaccagctccaaaaactgtatttttcaaattcactataaaaaataacaaaaatatattagaggaaatttggagacagaggaaggaaggaaaacttccttttacttttgttatatttttctttttcatggtacacaaacatgcctgtgactgcgagtgtctctatgcttgtgcatgcccctggtcattgttgtccatggcacctgtcaacctgtgttctttaaagtctgtattataagcattcttgaggttatctttagaaccatctttattttttagagacagggtctctctcactttattgcccaggatgtagtacagtggtgcaatcacagctaactgcagcctcagtgtcctgggctcaagtgatcctcctgcctcagcctcccgagtagcttgtcccacaggtgctaccactcagctaatttctttttttgtagagatggggtcttgccatgttgcctaggctggtctctaacgcctaggctcaagtgatcctcctgccacagcctcccaaagtgctgggattacaggcatgagccaccatgcccagctccattgttttcactgctgtgtagtattccgtgtcacaagtaaatcatgacttactgcacattcctatcccactgtatcaccctcattctccccaggtgctactttataaataatgctgcaatgaacacctcacacactggtcagaatttaaggtcctttgtttaggctggattcctagaaatagaataagtgagagagacaaatattctccacatttttatgataaaaacgagtgttccttttacaaaatatctttaaaagtattcatttatttcactcatatcagatttggcaatatctaccaaaattataaagtgcaaatacctctgacccagacctcccgtctggtgaatatattcagagaagttttcacacaagtacagacatgtatttatatagcagcatcatttataatggcagaaaactagaaataaccaaatttcccctgcactgaaggctcattaaatgcactaggctatactcataaaatggaatcctttgcacttaaaacacgaggcagctccatatgtacagacatggaattttaaatgtattaattgtattacaatcctttgcgtaaaataacactgatcatgtttatgtcgagcaaggtaaggtttaataaagtcgtgacccacttaacactagaaacgggaatggtaaattctgacaggaaggccaggatcttcactcaagaatgttcttcctcctgtagcccgtctcacccagctatcagaacacgcatcccagtctagggtcagcttctgcaaacacgcatcccagtctcgggaccgcttctgcgcctgtcttcagaattacacccggtgaaagtggacgtctctgtccgttcccctggatccacggcggcggccgagagctccagggttttctcgcgctctgtcttctgtgcggcacccggctctggggtcagagagatcccggcaagagccctagccctgaccccaaccagggcgcgctcctgagcaagtcacccccctcctctgatccgccagctctctcctggggctggaaacatccttggggttattgtgtggagtacacgtgataacgctggaacctcagcctagtgcctggcgcagggtacgcaccaaataagtcttcgctgttaccatcagtacctctcttagccacaaatctgagccagtcctcgttgacacaggcttaaccttaggatagtcacaaagggcaactcaaatgttaacgtgcagctcctctctcttgcctcacaggggacagggtcagaaatatttcatgctttgcaccttttccttgtagtgatcagtaatatttttaagaagggagagattttataacttagctatgacacttcagagagggctcaaaagtccttttgatacaataggtaatacttttctggaaagaggaatgactgagtgcctggaatcatatcaatggcttaactaacctttggtttcacagttttcctacttggtttggttttgtttttttttttttagagaacgtactgtactagaattcccttgtgggataacttcacatagctgatgatcattgcaaggcttgttgggtttgtggggactttttggcaaatacagccacaatcagaattctctgtggaatacatgatttctgttctgatctgacgtcaccctgctggccatcctcttagcagacgtgagacagctctatggagatgaaggtggagagtttgcctctgtttctgatcagtgctgaaattcctttctgtgtctttctgtacgtggatgcagccatcagtataagtcttttaaatcgcttatttgttgtcattagctgtgtttggttcatgctgtactttcttcaccatagggcgtgataagagcttttaagtcctgttataatgcagttcaacaacacctattttttgcctgagctgaactaagcagttttatttgcatacatttagaagaccaaactgcagccttgagttcaggtagttatgtaaaatgtgatgagacgcaggagtgatgtaattactccagtgtgaatgcatttccctctctgcggttttactgggtcaagtgcaccgctgcattaattaaacaaatgcgtaattaattacagcaaatccacaacaacaacaaaatagtcccttgcccaggccccatgtttcagttctaaaataagacgttctctgttgaattaggtggaaacggccacagattctgacacggagagccgcggtctgcgggaataccactctgtcggggtgcaagtggaagatgagaagcggtaactcagcccctcctgacacgcggtgacccccgagcgagggctctttgtcaaaggcctgatggaagctcctagatcctgccggccctcaatcatgcctgtccttgtggaaacagggccatacgtttatacttttccattgataaccctcaagtatgaattaacacccgcctatgtcttgtttttgcaagaggcaagggagtaattctttccaaagtaatttatcacctctgaaagcagagcagctgacggcctgaaagtcagagtccttgatccaaaggaaagaaggacgggctgagggtgacgccaatgcaggccttacgccttgtcatgttacacgtaaaacgatagaaagacagcaaagcacgttcaaggccttcatacaccgtgaaattgtttcacttcaaaaatattacctagaaacaaaaaatacaaagtgatatccattagtgttatttttgtaacaaggcaggacgatcattttagtttatatttaaaatagcatgtattgtctatttcataaaaacaaattttgatgagaatattacatggtgagggctcagccaatgtgtgacagggacagtgttgggtggcctccctcatcagggagcgttttagcacccaccctatggagattttgattgcaaagaaattccgaccccagcttatggcttccccagtttccaagagacctcctagaacctggccatcttctgcacctgggagccgggcaggctgccttccatcctgctctgtggctcagtgtccctccctgtgcccccagcaaagggaacacgtggcaacgtcactaaccagctgcatgcacagctgtgtgcttctatgggttcagcctgcagagccacagggatggctgcagtagctgggactatgtagacacagagagacacacacacaccacacaggcacacgatacagagcatacccacgtgcacacacacgctcacagtgttctcacccagcatactggtctccaactgtaagccccctcctatcaactattttggtgatcagctatgtggaaaagatgacattaaaatatagacagtgaaaatgattttccaacacctgccaaagtcagaatttggagtcattattttgcatacaggggttaatggggacatattaaattatccagacagaagtggctcaggccctgaaacacaatttggaagccactacaactcagtatgatgttactattgtttacataaaagaagcaacccatggctttggctgcataagctcgtagcatatttctgaaagggaggtagccatttgctaatggtggtttcaagaaacacgttaactctcattgtatcattcaataaacttaaatcccaagtgggtgttatttaggcctgagacttaggcagatgttaaagtataatgatttgcaaaaccaaatgttcttccacagacaaaacaccagcatatttcacaaacaaaacactacctgcccttgagccgccaggctgttgagctcaggtgcgctcctgacaggcgacatgtaggactttgttgcatgaagtcctctcagaagggctaccatctgtcttccttccctccttttgcagacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaagtaagagctcaggcttccctagggcctcttaaatatcatttctcagtaatgcaaatatgcacatcacagcattagtggagaaaagttcctccctttggtattcaagtgaagggaaataaatgtgctttctagtatatccccctcaattctaagaaaagatataaattacatgaaaagagaagcagtcactacgatatcgaaggaaaattgtgtgtgttttgtcaggtaagttgaatagaaaatcaactgtgctaacagttttcttgggagcatagttgatctcatattccacttagcagttctcttgaattttggcaaaaacttaatttgcagcatttatgttattttctagaattgttaccagctcatgctttacaagaaaatgccttggcattatgccaaagagaagtcgatggtaagtaaaagattaagttagttaactgtgtgatgatgtgctcaaaggtctcactcctgggtggaatgggaaggccgtgtcattcctctaccagagtcaccaccaaaggtctcactcctgggtggaatgggaaggccgtgtcattcctctacgggagtcaccaccaaaggtctcactcctgggtggaatgggaaggccgtgtcattcctctaccggagtcaccaccaaaggtctcactcctgggtggaatgggaaggccgtgtcattcctctacgggagtcaccaccaaaggtctcactcctgggtggaatgggaaggccgtgtcattcctctacgggagtcaccaccaaaggtctcactcctgggtggaatgggaaggccgtgtcattcctctacgggagtcaccaccaaaggtctcactcctgggtggaatgagaaggccgtgtcattcctctaccagagtcaccaccaaaggtctcactcctgggtggaatgggagggccgtgtcattcttctaccagtgtcaccagggcagatctgtcccagtcccgttggtactcacctatgcctctgcttctccacatggaaggggacagccccttattctccgcctttctcccatctgcctagagaaacctaccatcaagaccgttcaggccaggcacggtggctcacgcctgtaattccagcactttaggaggctgaggcgggtggatggcctgaggtcaggagttacagatcagcctggccaacatggtaaagccccatatctgccaaaaattcaaatgagccaggcgtggtggcgggtacctgtaatcctagctatttgggaggctgaggcaggaaaatcacttgaacctgggaggcagaggttgcagtgagtcaagatcgtgccattgcactccagcctgggcaacagaatgagactctgtctcaaaaaaaaaaaaaaaaaaaaaaaagagctcagaagcagcacccattataaattgctgtatttgattgacttctaagctaataccacctgtctttgtttatagaccaattacataattgcacaatacctacaactaatgcttatgtttaacacagtacaatttcacaaagctatttctgaatgtcttgacaaattacggtctaagtatttttctttttctgtgaatttatttgtacattgacaagatcattataaatgctgaacttcaaaaggatagctgagatccttgggaatttgtccctgacatttcatttctagatggctgttttaatagggcattcactaatcctagaaatagaagtgcaacaatgaaactacattgactatgacttacagagaataacggccttggagcctcggcagtctgagaaaatcaatggcgtgctgattttttattgttaaaacttaaggtctgaacctatgaagaaagaaagacattgcctttaattgactaagcctgttcttccacatttgtctcttaatcatcaaatcccacctattctttacaggaggtgacgatggacgccgaatgttggggagatgctgccttccacgtgacccacagtccccgcagcacggctgcatggggctggtgcaagtcagcacagccgtgttccgatcgttcacacggcgtttgcatttctcatggttagggtacatttaacagagtaacttcacaattttgatatctaaaaatcactcattttctgcagcatcttccacccttgttagtatatgcctcaacttggccaaattgtcttaattataaaagggatttataatctttagcacaaagataaaacacagaaaaactgcattgcctaagttgacgccaaattaaattgccagctctggttttgtgcatgctgacaggggcagcgtagggctggggtgccttccttccaggatgagagcaggtgatgagacctgcatgtcactcaatcaagctgtgttttctacaccatgtgtttcctcaaaagaacacctttgaggaggaggagagaggaaaaaatttaggagagaggaaaaaatttacaaagaggtcatgtttgtttgtcagggcttagcccataaaatgcctataaaattgtatcctattatcatttgagtttatcccattcgggacacattcagaaagttgtagtcttctttggaaggtgtaagacattgagacattagccattactgtgttgataacacagagactacttctcctgtcatcattttccatgtttagtgcatactttcaatttcattttttcaaggattatcatttttgaaaagatatcttttaaaaaaaaatagaatcctcagctgggcacagtggctcacacctgtaatcccagcactttgtgaggctgaggcgggaggactgcttgtgcccaggagttttagaccagcctggacaacacagtgagaccttgtctctaccaaaaaaaataataataataataattaacattttaaaaagtagcccggtgtggtggcacatgcctgtagtctcagcttctcaggaggctaaggtgggaggattgcctgagccccagaggtggaggctgcagtgagccgagatctcaccatcactgcagaacaagaccctgtctcaaaaaagaaagaaagaaagaatatctagaccagttctccctgaacacatatgatatgtcaggccctgtgccgaatgcactgcagacctcattaatgctcatcccaatggactaggtgagtagtattgtaagcattctacagataaactggggctctgagagattaagatcttgccccaaatcacagaatagtagcggtgacccgggactgggagtcacggccctctgacgttgaaggctctgccttcccagcagtgatctgggactgggagtcacggccctctgacgttgaacgctctgccttcccagcagtgatctgggactgggagtcacggccctctgacattgaaggctctgcctttccacccacggtccaaaggcatcaagtcaagaagttcccttatgggaagcaccccctccactgcctgcttccatgctggatgtgcatcccatcctttcacctgctgtttcagacaagggtgtgtcccatccctgacccttcacctcattctggtcctccacgactgtgacccacgtgtggtccacagagtccctcagctgcgaagacagaggccaaggttctcccgcgttagccattggaaaataagtggcaggagctgtaaggaggcaaattatttctcaaaccaagaatgaaagtccctacaaagggctttagtgctgaggccctgtcatggtaagtcctggttttctgtcactggaggcattccagaatattctataaattatgccataaaaatactacatacaaaattgaatttgatgacgtatagggacccaaatcaacagtaagattccaaaatcttaggatatatagtatttttttttttttgagagggagtcttgctctttctcccaggctggagtgcaatggcacgatctcagctcactgcaacctcagcctcccgagttcaagtgattctcctgcctcagcctcccaagtagctgggactacagacacgcaccacagcacctggctaattttgtatttttagtagagatggagtttcaccatgttggccaggataatcgtgaactcctggcctcaagtgatctgccccccttgcccttgcaaagtgctaggattacaggtatgaaccaccatgcccagccaggatatctagtatttcagtgtcacttaccttattattaggcatctgaaaaactatttttcttcagtaaggtagggtggaaaattaatttttgctgactccaaattatattcccctaaacatatgtttggtttcgtggtgggatttttgttttgttttgtcttgttttttaccttttttgagccatcaggatcctcctctggactctctcagtgatgtctacattccatagatatttattgattacttacgacgaagcaagccactctccgatagacaaaaatgatgcaacaatgagtaagacatggtaaaggacctaactgattacctaacagtgggagaagaccaggtacaggaagtggaaactgttgagtgtcataagagaagtacagataaagtacttaaaaactcagaggtctcagcaatgctttcacctgggaagattctcagaaggcttcctggagaaggtggcactgtgctgggccttgacacgcggttggatttggtcaaggtggtggatggtggtgactgaaaaggagattcaagagtccacgcagaggcagagaactggggaacagaggcccctttgtctccttcctctggaggaagatcttcatgtcagcactgcccttcatcctgcctgtggggagggtctgtgctacctgacctcacagagccttctgtggccggggcattccccataccctgggggatgatggaacttgcctaaagctccgcacctctgctgtcatttgagattttaggctccttcaatgaagtggccacatttgacatttatcatccacagacagtgcctcacacatcgcctggcacagagtgccagacaataggaatggggaggaagagagggaagcaggaggatgggctgtcttagcgaacaggatgccacactcctgctcacacctttataaaagcagaacatctagactcccagagaatcacctcgccatcctcagttatggaggctgggagtagcttcaacacttcccattctatagacatccactgaaatgatcctgattttccttgtctttgctccactatatatatatatatatatatatgtgtgtgtgtgtgtgtgtgtgtgtgtgtgtgtgtgtgtgtatacacatatatgtgtatatatatatgtgtgtatatatgtgtatatatatatgtgtgtatatatatatatatatatatatatatatatatacttttttttttaagacgaagtctcactctgacaccaaggctggagcgcagtggcgcgatctcagctcactgcaacctctgcctcccaagttcaagcaatgctcctgcttcagcctcctgagtagctgggattacagctgaatgcccctacacccggctaatttttaatcagaaaatgtaactgcattgctataaactttgaacacaaggaacagagaatggatgaacttgatactttttgtgattttcttaatttcttaaattgcccagataccttcatctttttgtggacagatgtcaaaacacttgttatgcccctcatctgtgtgttttgtccataaaactagcacaatattcatcaagttcagatatttccctaaatgtttaaaaggtaagatgataaccttaatttccagtcctaattttaggagcagatacagggttattggttatggtactttttaaaataaagattaaattaaatgtcttatgagactaaaactctgatctctgaatattgaaatttccattatatgaagtaatttttgcccaaaatataatttcataacacagttccccgaactgattgaatgaatctagattcagtcagtcttctatggttaataaaatctatagtgaacccaaagaaatgctggtctgcataaagtcacattaatgcaggctgcctattgttaataaaagtactttcaagatattaaatcattagtaatgttttaagatttttgtattatgtcaaaccaaatgggtaaatacataaaggaaaaatcaaaaatgtgcatattttctaaaacaaaagaaatccttcccaagctaagactttattgaataattccattgagatgcaactctcatcaagaactcaccaagggagcacatgtacacacaggatctttcaaacggtatcggaaacttccttgccccaaatgactcctcccgaagtaacgaataacctacatgttcaccgggtcagatgcacattcaaggcaaacactaatgctgggaggaacatagggatttgctcactaagttctccttttacagccagaatgaccacaagtcctattaacacaagagccggggtcagatgtgtgactttgtatctcctgggccatcttccatgctgagacaaaatggtctggatggggagaagcaccccggcagttggcactcacacagcggtcagcagctgacaaagagcccagagagactctgagaatgagcagaacacatgctccatgcagggcacgaggatgacatggccacagagaactgtgcctgtgtccatggttggcccaggtggtatcagaccaacagagaagattgaggaatcagaaatactgatgacgttctgagcacagcagatgcctgtgcacatattggcagctaccagccttaggggtcaatgtatcacacagcttaatggaacgtccactgcttccagacctcctgggagatgcaggtcatagactgtgtccattttgtggatcagactaagagaatcaacccactgaccaggcctctgctaagcacctatgaagatgttgccatacaacccaactaaatggtcatggggaaatcagacaataaaaagacatggatgcttgtcagcacaggaaaaggaaacagcagagtgaaaagacaactcacagaatgggagaaaatgtctgcaaactgcccatctgacaagggactaagaaccagaatatacaaggagctcaaataacagaaaaaaaaaaaaattcaaaaatgggcaaaagacctgaataggcatttctcaaaagaagacatacaacgggccaacaggtatgtgacaaaagattcaccaccactaaccatcaggaaaatgcaaatcaaaaccacgatgagatgtcacctcatcccagctagaatggctattatcacaaagacaaaaaaacagcaaatgctgtcacaggtgcggagtaaggggaaagcttgcacactgctggttggaatatgaagtagccactatggaaagcagtatagagatttctcaaaaactagaaatagaaccaccatgtgatccagtcattgtcctgctgggcatagacccaaacaaaaggaaattcatatgtcaaagggatttctgcacccacatgtttattgcagcattattcatgttagccaagatatggaagagacctaggttcccatcagtagaaaaatggataaagaaaatgtggtaagaaagtaatgtgtgtgaataatattcacagtggaatattattcagccataaaaaaaggaattaagtcttgtcatttggagcaacatggatggaattggaggttattatgttaagtgagataagccaggcacagaaagataaacactgcgtaatctcactctgatgtagagctcaggcgggcgcagtggctcatgcctgtaatcccagcactttgggaggataaggcaggcagatcacctgaggtcaggagtttgagaccagcctggccaacatggtgaaaccctgtctcaactaaaaatacaaaagttagccaggcatggtggcgcacgcctgtaatcccaatcccagctactcaggaggctgagacaggagaatcgcttgaacctgggaggcagaggttgcagtgaaccaagatcacgccactgcactccagcctgggcaacaagagggagaccccatccaaaaaaaaaaagcagagctcatgaaggtggagagtagattggtggttaccggaacaggagagaggaggaagagaagttgattcatactaatgggtacaaaaatacagttaggtggaagaaataagttctagtatacaatagtacagtaagaaaacatggttaataatgtatcatgtatttcaaactagctagaagaattgtaatgttcccaacacacacacataaatgtttgaggtgatgcacgtcccagtcatcctgatttgatcttagcacactgtagacatctgttcaaatatcatatgtgcccccaataatatgtacaactgtgataaatccattaaaaacacacagaaacgtgctcaaaaacatgaaaatcatgaggctcgagatcttgaaaggagatttctgggagccatagcttaggcagaccccactacaaaattagttacaagggaatctcaggggatcacaggggttacaaatactcaaatgatcatttccgactctctgcaaattttataaaaatccatctcaaatattagaacaccagaatagtgtgaattatgttacttcataccaaatttagatagaattggaattatagaaaaaataaaagagccaagtgtgttaatcaaatttctttgtacatggaaggcaagggttctagcaggttctttgtgaatttgcattctgatgagaattagtccttagtatagctcctgcaagtgtctaaactatggcaaaattagagacatatactgggagagaataaattgaattttcacttcaacttctttgcaattataggaagctacttacattataggcatcagataggatcattctcactcactgaacagcaaaattctcctaccattagcaggcatgtcattagctacactttttgacattcattatctctccctagcaatattcaatttattccctttataataactctccactacattaaatcgataccaagattttgcccatgtgttcatgttgtgttaaagagtataaattgaagtactttgtattaacagttcagttgaattccattttaaggggaatgtgaaaattgggaattaaacttcaaattttaagaaactgattgacttttaaattacagtttgaggaagcatagagttggcaaaataaattcatttattcatccacttctatatatttctgcagcaacgacttacttaaaatagtccctttaaatatcttcattaattacccaggttttagaatacaaaagaaatagaaattcaacatttcaaaagcaaagatgattcctcccctcgtcatcagcgagtccagggctgcagaacacgttcattttgggggcagtggaatgcacaggaaggatgaggagctttcactgtcacccctgtcaagaaaccactcaaaccccaccgcctccagctgcttctcgaccgactgcagcggcccctccactcccctcacccccagactcaccccaactcagagccctgccagctccatcccgtgccatgtggccaggggctcctggcttccttctccagtcctcccctcccttctctgttcccaggctggctggtaaatcagatccaaggaagagcagcctgtcttgaagtggatttgtgaacggcacaaggccccggtgttaagatgcccgacagacaaccttccatccttcttttcaagacagaaacaatgccaaagtgttatccgagttacttgcttttattaaaagttatgcttttttcatctttttcataccctagaagcaatggagaattaggtgatattcaggaactattgtcaccttcgtgggggtgacagtggccctgggtctacaaggtggtcgcaggtaaaggcctcaggaagagagaacacaggacaacacttactgccgtctccacggaatggggagggagctgtgggttatactcttctttcccattttctgcatgtgtgaaaggtttcataataaaactttggggagcaaaacaatcttcattttagaaaaataagacaagacagaaaaataggtttttaagtccattatcctacccaggagaaaatcactttgaagaacacatggtacagattgccagaccttcatgttctaaaaaatgagggaggcaccgcacacactgctgtgtagttgacttctgggtcacggcgtgccataagccctttcaaatcaaggttatctctgcaacgtcattttcaactggctcatagcattttattacatgaacattaagaccctttgtgcccatgaaatgcggttctttttcccgaaagtcgggctaaggaggagacactgcagcaccctggcttgggcagcaggatgccagtttctggatcgtgtgcaatgaatctcaccagtaactgtctctaggactgactgttaaggaatgtttgggggaagagctgttgtggaagaacctacacgaggattgggttcacttccctggacctcggtttcgacttctggaaaggctgtctaggcttccacagtcaggtgtgccctgggagccagcaggggcatctcctaaacgtagaaagaaacggactttctggcccgacccggaccccgtgagtcaggccatgcccggcacaagatccccaggtgaggcacaggtgggtctgcaaggccccttgagctccaagcacctgcatgtgtctaggcaaaacctccagcacatcggtattcccttgtgaagtacgtaaagccacagattaagtggggatggatctctcgcctctgcgttcaagggggcaaatctccaggataaatgcccccttttcctacaccattttccaccagccttggagagtcagcttcccatggcttccttccaacggaagcaggagaaagggctgggctagttaaaccgcagcactttcagttttagggtgtgtcgtgtaggttagtgatttgtgctctgcagagactctccagggagagcaaaaagagcaggtggaatcatcagcttggccagaagacgcagatgacgccccgtgagccagctcaggaaagacggccccaccttgaagggcccacgctgaaagccagtgatggggagacgtggtgtgaactgagaggtgatgagatgcgtagatcatctgccccctgcctggtgggcagccctggccccacgtgctgacccaggcacagaaaagccacatacgtgtactgggcacgctctatggaagaacggtgaattgttgctctggcaaataatatccagcagagatcagtgggcccagggtgcactggtaagaaatgggttccagtcgattcctgtgtggttttgaggatcatggtgagctaggatctaccaaagcagctgtttacaaagtggtgaccatgctgacagcagactcaagagagggtgtggggccgggtgcggtggctcacgcctgtaatccttggccttgggaggccaaggcgggctgatcaccggaggtcaggagttcgagaccagcctggccaacatggtgaaacgctgtctctactaaaaatacaaaaattagccaggcatggtggcatgcacctgtaatcccagctactcgggaggctgaggcaggagaatcacttgaattcaggaggtggaggctgcagtgagccaagatgacgccactgcagtccagcctaggtgacagagcgagactccatctcaagaaaataaataaataaaacaaaataaacacacacacatacagtatattcttttaaaaaactttacagccaggcacggtggctcacgcctgtaatcccagctttttgggaggctgagatgggtggatcacctgaggtcgggagttcgagaccagcctgaccaacatggaaaaaccccatctatactaaaaatacaaaattagccaggcatggtggcatgcacctgtaatcccagctacttgggaggctgaggccagaaaattgcttgaacctgggaggtggaggttgcagtgagccaggattgcgccactccactccagcctgggcgataaagggagaccctatctcaaaaaaaaaaaaaaaaaaaaaaaaaattagtatttgattaaccaaataaagtcattgcaattaggaaccatttgtagattaattcttcctactgaactgtggcctgctgactcatagcacactcagaaatgtagcgttagcattacacatatactgggtacatggattggtgagtttagtagctgtgagcatattcagtaacttgtgacccttttaccatctccaggagggaagccacatcttcctacgtgctacgaccttcctgtgaggcctctgtccacgcagcctcttcctacgtaacacacacctcacagcactgccaggagataactgcccacagttcattagaaattatttaattgaatccaatgagagaacccatatggatgtgttttttctaaaaatgaaggaattcacatctaaaagagttcactaacatgttagagtccataaaaataggaagaactcgatgttgctttcactcacacgtgttcttgtgtcttccagctcatccaaacagcagcactgaaataatctcgatgccaaaataaggaaaactccctgaggtataggccgcctttctaaactaagtttctcccagtacccaaggagaatgtcctcacagtgacatctggtcatctctggatttccttcatgagttggggacgagcacactaaggcacgagtcaccagcgaacacgctcggcacgatgaagtcgtcagttttcatctccagtgggactcgctcccttggtgtgatgtttctgcttttgtgtaattgacccagttttgaagttgttgtttttttgtttttgtttttgttttaaacagttctcggtaaaatcaggagtgctgttgggagtgcccagcttctcatgtcccagaaattccagcagttttattggctttgccaacagaatatggtaagtgaatcctcagtgaacccctgttccctgtaaccaagctaatgggcatcattccacagattctcattgttttcttccttgtcaaagagttcccatcggtatgcggaatatcacgtgcacttactacagaagaggcttcccgccctggggaaagagacgattcggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggcggatacggccctggtttaaacgcggtaccgaggcagggaggtggatatggccctggtttaagcagtaccgaggcagggaggctgcaagggggagtggaggacaggaagaggcgggctgcagcagcgcggcgtgacactgtgtctttgcaactggatgccccaccagagcatcttagaagaggagaaacaagggaaatttctattacgtctaatgtcacaaatgaagaaaatgatctaaggtgcctggaaataaaaatacataaacaactacaatgaagagattaagaagagattttgcaaataatttagcctttgtattttatagtcggtagtgaaacgaatataccatgaactagatgattaatacagttgacgttaaacttggttattcctgacaagcaaacaaaaagaaaaaccacatatatatttacatatacttacatatatacatgttaatatatacttacatatgcttatatataaatatatatacacatattaatatataaatatatatttgctatttctggcagagcagaaaagctcatatatacatctcatatatattagatgtatacaagattataatcatatgcatctatatgtttatatatacacctatatataaacatatataggtgtatttatatataaacatatatattaacatgtatatgaaattttacttatgtatccttatatatacatgctaaacattaacatataacaaatatataacattaactacatattttatatatacaaatatatagtatatataaaatatatagtatgtgtgtaggcaaatatacagtatatataaaacatgtaagtttacatggtaatatattttatatatacatttgcctacacacatgcatacatatacattctatatatactgtatatctaagtttacatatacatgttaatatattttatatatactatatatttgcctacacacatacatgtatacttttccttggctgactaaagtattcactattttgagaaatagtaaataatagttatgctacttaataagttgttttataatacatacatcgatttcttttcagaccaaacattttcagtcaaatgcaaataggtcttctctaggcctcgcgtagcaatggtgccaggtgttttgatgatgttttccttggctttttcacgtgcaaggagacataagaatattcttacacatcaaaggatgcacaagcaagccagagttgccatctcatgtcttttccttaggatcattaaaaagtatgccttctctaatactttccaatcaaccccactgaagttcacggcgattttaaagagtcaccaacacatcactctgacaaagttataatcatcatttaaaagagggaaatagaaaggttttgagtgcctcgaaagaagcctgtaactgtgtaaacattcagctgccatgtcacctgtgaacgttcttgcctcctccatagtatctatttgattattacctttaaaggaattgattcgggccactgacgaactctgtgtaacattatgcagactcgggtgagcctaggcaggcactgtctttaggaatgctcatccaaagcttcccacacacagcccaaggtgcatattcagacctgctaaatgttcctttctgctctgccagaaatagctaatatttggcttaaaattgttcatcctaatatttgttatgccttttgagttttaaaatagctggcttggctacatccttttctttcaacttctattcaggattagtagaaaaacactttgacacgtttggggcggaagagtggtacagggaggggtggtgcctgagacaggcctggcaggagaggagtgttgacttgttaagagatgcttcgctcatcaaagccaaatggtccgcagcgcaaagtagcaccgctgtctgctggaagttgttggtaggtaactaagctttaagtcaaagagcgaccctagaaaatgtcagaaccccagcccgagattgaggactgaccacagggagcggagcctttcgggacggaccgcggggggcagagcctctcagggtcgggatgtgcaggtggcttgtgacacaaccagaaggcacataataccggaaataacttaacctcaaagcgtgtggcctgattgctgtgcttgtgggaccagcagtttggtgtccccagaaacttagtctcattcacacccactgagcctgcctctgaattttaactccatccaaccccggggggtgtgtgcctgagcaggtgccggcgcacagagagctgccccaggccacacggggcaccgaagttcctatccaatggacgccggatgccagagccacagagctgtgtgaatttaaaagacggcaatttcacaaggaaagaggccctgcatgagtttgctgggggaaagggaatggcatggcacaaccattgactttttttttttattataaacaccttatcatctctgaatgttcagtggattcagatgcaaccacctccccaaccaaaagagaacagaagacaaaaccaaaccctgaccatgccaggctgtgcccgtccggccccagcatgtggtctgggtgagcccaaaggacgggtgtgttgttgccgaggagaggaggggggcacgggaaggcgatgcctgctctcaggcagcctctgccacagtggccggccatgttcctccttcatcccccaggagatgtgaccaggaccacccagctgcgggcgagggaggagaagccactccgcttcccccacaccatcaggcacagccgtgcccggccctacagaaagaggggcacagccatgaccggccctacagaaacagggggcacagccatgcccggccctacagaaagagggggcacagtcatgcccggccctacagaaagggggcacagccatgcccggccctacagaaagagggggcacagccatgcccggccctacagaaagagggggcacagccttacccggccctacagaaagagggggcacagccatgtccggccctacagaaagagggggcacagccatgcctggcactacagaaagagggggcacagccatgcccggccctacagaaagggggcacagccatgcccggccctacagaaagagagggcacagccatgcccggccctacagaaagagggggcacagccttgcccggccctacagaaagagggggcacagccatgcccggcactacagaaagaggggcacagctgtgcccagccctacagaaagaggggatgttcttaggttggcgaagacttctggaagccaggtaggaaccacccctacagcctctgagcagcctcccctgctgcttgtcacctggcctggcctgccctgaggctgcagctcctggcatccctcgactgacttcggtgcagaacgtggcctccttgccaggcactttagttatccccacccacagaggctgagttcgggctcccagccgctggccagggccgccctcctggggagctcctcaagtgcctgggggggctttgagtggccaaggctgccctcgtgtggctgcagagaagaatgggctcagccgcgcggagggcagctgggggccccaggtcctggctctgggtgaggaatcgcagagctgtccgttcagcatgctcttcactgagcatgctgagtgtgcactgctgaaaccataagcaaatccagttgaatgttgacccaccagaacctcctctgactcttttaaatccccactgaatcaagggagccacacctggaaaaatcattcagatttcaatgtagggagcaagccgggcacggtggctcaccctgtaatcccagcactttgggaagctgaggcaagagggttgcttgagcccaggagtttgaggccaccctgggcaacacagccagaccccattgctacaaaattaaagaaattagctgggtgtagtgacctatgcctgtggtcccagctacttgggaggctgagcaggcaggatcccttcagcccaggaggtagaggctgcagtgagccatgatcacacctgtgctccagcctgggcgacagagaaagaccctgtctcaaaaataacatacataaatgtaggcagctggtggaaatcatgtatctgtcaggcactgggcagagaaaccaagcacgtctctgggccactcggcccagggctgcagcccagcagcgtcacctgtgcctcctaagtgtgggcgccggttggtgagagcatcctgttccttggcgcattacatttgtaaggtgtcatcaccgtaagaacgagagctaagagccgtcagagaacaagcaggtatagaatgggctccaagctggttccccactgccaccaccaggccaataccacggcaggctcacggagccctgtcccttccgaatcatccacaggtgaccaaaaacacaggctcctactgcttttatgagctgtgaagcatttagaaactctcccatctgccccattcccagcattttcaacgtggaacaatgaacagctgtgctacgtgtttttaggccgacagcaaatacgtgtgctaaagtaaactgtcatggaagcatggccttcccaagtatctgcctcaggctggaattagccaggcttctccctaatccgcctcttgaaaggcatgcgtggggaggagtggcctccccagccctgtgcccgcaggagactctcctggctctgaacaccctgtgtgtgtccccaggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggtaagggcatccatgcagggccggctcccagcaaaccccctttctcactgcactaacgacctgctgcagatagagcatgacaacggggttctcagtcttttgctggcaacacacgagcaaatttccctctatgtatgtgtgcacatgtgtatacgcacatgtgtgtgcgtgtgtgtgcatgtgccgaaaatggggcagaattgaagccttgggcatgggtggtaaataatagggtctcccctgctctgtctcttctatataagcctttcagagagacactagccaagatcacaagcaaacctgcagcctcattcctgacaggggtctcacctatgaattatctttatcaaacttgttctcattgtgtaaatattaagctggcttcccacagggaaagttttaggcctggttatggactatctcctattcaatataccttctagtatggccactataggcaaggcgacattttataccttattgaaccgtttgatgaattaatcttcctgtagatccatcagcctcaacccttaaaataggctgaaatttgccattaaatctgaaccctggcatttcacttcttccgtgatgctgtcatcagaagaactagtagatagttctgagttagcagcaaagacatagatttcctcacacgttttaaagacgtcctgaggaaccataaatggatttttctagacaaatgttattaattaaaatgataaagaaaatcaagtcagcatcctttggggaagtggtgtttggtatccagcaaggatgcacacctgggtcatgagaacgagagccagatctagtggtcatcatcatcggctcctcccagaaggtgccctggccactagtggagttccaggccagatgcaatggatccacaggttccctctcatcccagacgacaggggagtgaggtgggagtgcacagggtccacgtaagccatgcgtgggacaggtccacataagccatgcatgggactaggcaggtccacttaaaccatgtgtgggacaggtccatgtaagccatgtgtgggactaggcaggtccacgtaagccatgcatgggacaggtccacgtaagccatgcgtgggactaggcaggtccaagtaagccatgcatgggagtaggctggtccacgtaagccatgcatgggacaggtccacgtaagccatgcgtgggactaggcaggtccacgtaagccacacatgggacaggtccatgtaagccatgcatgggactagacaggtccaagtaagccatgcatgggactagacaggtccaagtaagccatgcttgggacaggtccatgtaagccctgcatgggactagacaggtccaagtaagccatgcgtgggacaggtcagtgtaagccatgcatgggactaggcaggtccacataagccatgcatgggacaggtccacataagccatgtgtgggactagacaagtccaagtaagccatgtttgggacaggtctgtgtaagccatgcatgggactaggcaggtccacataagccatgcaggggacaggtccatgtaagccatgtgtgggactaggcaggtctgcgtaagccatgcatgggactagacaggtcccagtaagccatgcatgggactaggcaggtctgcataagccatgcatgggacaggtccatgtaagccatgcatgggactaggcaggtccacataacccatgtgtgggactagacaggtccgtgtaagccacggtttggatctgaggtgaaggagatgatcagtgatgctcctgagggagaaggctgttcaaacggaacgtactgaagttagcccaggtgcacacgatggttccgtctagtctccattctttggtcattgagagcaaacgtgagcccatctacccaagctgcgcatagagtatgattctcaaaatggaaacgtctttgggaggccaaggtgggtggatcacgaggtcaggatatcaagaccatcctggctaacacggtgaaaccccatctctactaaaaatacacaaaattagccgggcacagtggatcacgcctgtaatcccagcacttcgggaggcctaggcaggtggatcatgaggtcaggagatcaagatcatactggctaacacggtgaaaccctgtctctattaaaaatacaaaaaaaaaaaaaaattagccaggcgtggtggtgggcgcctgtagtcccagctactcaggaggctgaggcaggagaatggagtgaacccggaaggcagagcttgtagtgagccaagatcgtgccactgcactgcagcctaggcaacagagtgagactctgtctcaaaaaaaaaaagaaagaaaatggaaatggtttctcgctgagggcagagcacgccagtccagaaagcgagcagatctccagcacagcagaggctccgtgcctgaacaggaggccctgcccctcctgaacacggcgtcttaaaaattccctgggatgggccctgcacagcatctgctggacactcctacagtgccacacccacaggcctggaagctcctttgattggggaacccccacaggaaatactgatgtgtacatctcacaggctcacagttcaggggacaccaaaagaggaaacagatcctcttctctccttttctcttggcatcccctgaactatgaggacagttatgtgctgaaaaaaggaattacttgttaaagtagctgaaggtttcaatgaactgatcccccccattgttttagatggatgccaagaagtcaggtaagagtcattgcttctggcctagtcacgtaaaacaagccgagggaacaaagttccagacaccaaagcaggcttcttgccacaggcctcctccgtactcacacaactgcctgtcttcccccaatctacaagcacctctgggctccctttggaatttttcagaggctgaagagaaaaagacatgagtggagttttcctgtttttctcccccaaaactagatatctgcttaggaaagtggttctgacgccttctgccgtgtgccctttcctgggaaggaaacagctggctacggagagtccctgtcatggctctgtccagaaggggagacggggcaggtcccactgtctttaggaacaatgtgaatcacggggcaggtcccactgtctttaggaacaatgtgaatcgcagagttagggacacagaccttttgtgggaacaagtgcaagcattaccctttgcatgtgttgcataattgtgagatttatctaaaacggcatacacgtattttagcgtgacttatctgagagtctgagctaagggtgagaaatacttgcgtctttttacaaagcaggcaagtgaatagtggttttataaatatcgtccacgtcaatgggattttaggccaattagcgaatcgggccagtgtttccccgcacacccattcacgtaagatggttttcatgaacatactggaatcccagagtctgcagaaaaccctgcagtgttgaatagggatgtccagcgatggtgtccaaaaccctcgcgatgctcggagatgacacagggctttgggaagcgcaggaatcgggcgacaatgtcagactagcgcagtgactgcagagacgcaaggtgcgaatctgcagaatttctttcctgatttgtccacgctgcccctgacgcctctgccccctttggagagtgcgagggagcttccacaaatcccatcctgtgcagaaggcaggcctgtggcctgggagccggggaccagggcagacgggggacgggagtgaaggatgcggccctgggggctgcggtcgggaagggtcaggccaggccccagggccgctgagctcgcgagctgctgggaccctcctccgagcacctgccaacggtgacttgcgctgcttttcaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttaa

SEQ ID NO: 781 - DNA, 314599 bp, Homo sapiens
ggcggccgcgggcccggcagaaggccgagtaggagggaccacgcgccgggggccgcgatctctggcagggggcggtgtgccagcggagcaccatgcacataggcgcccagcgccccaactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctggtaagtgcgcggcggcggtcgggcgcggggacccggggccccgggccgggcggcgcagctgacccccgcccctccccttcaccccgtgccgggagcgagcctccattcccgagggggaggctcccgctttcccctttgtggccccccagcactcctcttcacccccctggcagtcccccgcgctcagtctctcggggtcccgggatggggatgggggctcagggccggctgcccaaccagcctcgaacccattgtctggctggagaggcacctcacggcgcgtgtgcccgggaggtgcggcgtgggcgtgaagagaaggtggcgcgggctgggaggaggaggtggcgagccgcttaggctttttttttaaaaaaaacaaaacaaaacaaaacaaaacaaaacaccctgagcccctgcggaccatccctcgggcggccagcccgggacctgcgaagtccccggcagatggggcgcatgtggccggccgcgggcgccgcgccgggcggtgagcggaggcgaacttggagggctcacgtcgcggcttggccaaggggagcttccccgaaagggaaagcggagacccacagcagtgcggcgccccggcccttggcgaggagcaggggcatctgaaacccaggccggggagaacctcagcgcgttccctctagacttaaatcttaaaccacaaaaatgtggagttttgcggggacgtgttgcgagctgtcctgactgcacgggcgacccctcccctcctcttgcacgcccagccaggtcccccgctccctcctgcattccgcttctcccagctttccagctcctcaaatccaggactctgaaaactcccctctttctccctttcctgctgggacagtgtctgggcccctcccagccgaggcttgtgctgtgagctgcagagggtgtggcggcttgccccagccaggatctggactgctgttggtcccccagactaccagttttagtgtcccagcctcttctaagggatgttgggagggacacacacaggcgagattgggctcattcctactcctgacacttggacacttctcttttcctagttggttacctctaaactccacaagactaggcagcaagggaaactcgtgatccgggcagccaacgattgtgcctgcctgcgggttttcttttcttcttttgttttcatgaaaacttagaactttggcagaggactcgagttctagatcaaaaatcggttttctgaggtgtgctcagctacaggacgttcaaattgcctgccttcaggccttgaaaaaggaatggtttggtatgggaagtgatgttctggatggcaggttagctgtgtgctctttgggagaactgagctctctctcccgccacctggaaactctggtgtggccgtcggggagacagatgaggttgcttgtgttgctttgcatctcctgtgatctcccacagctgctcccaccgttgtgcaagatgggacactgaaatgaaacggcctaggcataactctcaaggcggcctgggtgcatacttgacctgcttttccagagacaaacgtttttcttcaaaaccctcttcctactagacatatggttcttacctcctggctctggctttttttcctcctggctctggcttttttgtttttccatccatgctgtggtgctctgtgtgtgtgtgtgtgtgtgtgtgtgtgtgtgtctgaatacttgtggtggaggagccagtgacacagggaaaccagtgcagcagccataataataacaataatgcaattaagttctgcttgactaggatagcatttttttttgcttgagctttcatttaccctgctgattaataacacatggtgtgaattaatctttagaaaaataatgtcccatcattaacatggtggatttgtgttcttgttaaggctagcagttgcaaatatagtatttagacaattatgattgtacatcccaagcttcttggggcagggttgttgtggctacttttacactactgtgtgtcgcagttactgggtgcaattccttttaaaattgtttacaatattctaagcctctcaatcaagaaacaaaaacaataccaggctgaccttttattgagtagagacaaagcttttgggggaccaggtcagcttgggaaccctcttcctagggacgcatttggaccattgatgcgttccttgtcccaggtcagctccacttgctctttgacaatctgtgagaggagttgaaaccttccagatcatctccgtgggccaatagaagtgcgcagtgttggtgatttctcttgttttttttttttttctggagttgtgtgtgtgataatctcaactttgcttttcttcatgagttgcttaagaaatcagttcaaaccatttaattgtggacatcaatcttgaaggacaagttttaagtggcagatttttaagtatgtatgtggagggcaatggaaattgtgttggcattattgataccagttcaactttcttgtataataaagatcatacgggtgttttgggaggaaaaccagatagtaataccgtatagaaaagtgtctaagcacctcattgtaagtatggctaacatcaataattaacagactgtttcaagctaggagaacagttcctcccaacttccagctctagaatatttaaggcctcagagagaagtaaacaaaaattaaaatgacaaaagtccattttatttcttgttaggaaagccttaagagagaacaaatctattcaatgactataccctccctccccatcagtttatatgggttaaattgtgcgaatataaaaaattagtgggtatgaatggaaatgagagaataaaagactaatgaattaagactagaggggtgaactttgaaaagtaatctttttaatagaaaaaaatggagttagtgactagcaaaaattggatcccagtgttaggagtttaatcctcccaaggataggtatcttcagtatcattatagtaatagttataaaacttacatttaagggaaaaaattactgtcttagtgtatacatttaaaccatttgcttccctgtattgacctttcaggtacagctggaaggtgagatacacacacacacacacacacacacacacacacatatatgcatatgcctttgtgtgtgtgtatgtgcaatgtttctgttatactctaacctatgtataatttatatggaagtgtttcataaattataaagtcagccacgtacttcaatctttgttcttttaggatgtaaggatgtatatatttcataggtaatattagcctgtgttttttgggggttcttcatatctgtaatagccatgtggccctccattgtatttattaaccattgtctaattttgggggttacatcaagcttgtcaaccactgcctgtgggcctcatgggcccaacgcaaattcataaactttcttaaaacattatgagatttatttcatgatttttttttaagctcatcggctatcgttagtttttgtgtattttatgtgtggcccaagacaattcttcttcttccaagtgtggcccagggaagccaaaagattggacatcctgggttacatacacacatccacaaatactcccatgtcttttatttttaaagatgatgataagaaggtggttctgggtggatgtggtgaacaactgatggtttttgtccgagaatacctgtttctacattagacactgcataatattattcactcatttttggcttgcagtcactgtttacaacttaaaaggcacacccttggatgcctttgttgaagagctatccttaaaattcttttgttgagtttcagaggaaaggacaattttaagtctgtgtcttagctgctgtatcttgtgcaatatcaggtgtcaggcagcactgcaaacagatttaaaattattaggaagtaatggtttagggcagtattatatttggtatcaggaactgctttggtatctgattaatttgagtccatttccttctcattttttttctgcatgtcctgagattgaatgtggtcattttgttttaggaaggagtgggaacattttctgagtatctactatgagtaggccttttacatgttctcatttaatgctcacagtaactaatgctatcagcaatactatagatgcataagtaatgattatttaggctgggcacagtggctcacccctataatcccagcactttgggaggctgaggtgagaggatcacttgagcccaggaattcgagaccagcctgggcaacatagtgagatcctgtctctatgaaaaaagaaaaaaaaagattagccaggtgtggtggcttgcacctgtagtcccacctacacaagaggctgaggtgggaggatcatttgagtcctggaggtcgaggctgaagtgagctgtgttcataccattgcattccagcctgggtgacaaagtaagaccaggtctcaaaaaagaaaaagatatctaagttgcctaaaattatacagttattaaataaccaatctagtctttcagcagagatttggatctgttccctactccccctggcctttcttttatattatgcttccataggcttagaactgggaagaaaaaaagggcctgcgactagcagtaaaaaattcctgtctggttagtgcaaatttcagactggataaagttggcagaaattcttcagaagtgactgaagtgaggtgcatttgaagtttcttctctttagatgtcaagccttttggcatcttcactgtgctcttctattttcaagcatggagttaaaaattgatctggtccaaaaaggtgctcttcagtttttcttttcaaggcagatttgaaataccttggctgaaaagtttgttctccaaatcagaaggaataggcaacctgtcagtgcaacgcatatactccaaatgcgaaacctgtgaaaaggaaaggaaggtcaagttgttgttttttttgtttgtttttctttttgagatggagtcttgctctgtcgcccaggctggagtgcagtggtgcaatattggctcactgcaacctctgctacccgggttcaagtgattctcctgcctcagcctcctgagtagctgggattacaggtgtgtgccaccatgcccggctgatttttgtatttttagtagagatggggtttcagcatcttggccaggctggtcttgaactcctgacctcgtgatccacctgcctcagcctcccagagtgctgggattacaggtgtgaaccactgtgcccggccggaaggtcaagttttaacatttaagtttacttcccactgcaaggtgttgctccctttcagccacttccaaggaaagcacttgccataaagtctgttaagcagatgggcgggtgggagtgtagtgaggccatcagatgctgctgatttgtattctcacattctttctcctgttgtgaggggaagagagtgtggaagaggggtggtggagtgttggcactttgaaccattacagtttcaccctaggcagtaactccctgagctgttttattctccaaagtgggaatatatggttagggctgttatcattatcaggatgcattttttcctcctaataataccagtaaaaactgtgacaatatattggggtatctaggatagaagttgatcaaatgcaaatgtttggctccaggaagagactggcaacagtgtaaagtgatgaaatttggggagagatggtatgcgtggccttaaatccgtaagtgataagaagtactttggcttgtggcctgtcatttagcattggcctgggaggcaggagacctagtttctagaatcatatttgctgcaccaacttggacaagtgaaactctttcctctggcccttggttttcctcctttgtgaatgggaataaaatttggcacaattgttaacatagtcgtgagatgatggaaatcataccacttgaaaacaaaatttccagaacataatacattgtgattcattagttgacattggcttttgaagagctttcaggtggaaatgtgtgtaggggtgttctgtgtggtctaaagagtagaattccccagggtcagtgactgaaagtcatatgagcatagggaaaaatattctaacatgtagagttgttgaaaatggatggtgagttctccgttaaagttattcagataatctgtgtgacaaacactggtgattggaaggccctttgcagcccaagaagataggaagtacattattggctcgaaagttgccctctttgaggtgagtctgcaacttgcaggttctagacatagaattataacacctgagagtggggaaagatctcctggtaggtgcttcctgggcttaaagaagaaaaagatacgtatgggctgatgtttgttctggaaattcatttgactttataagaactgttgcttaaagggtttggtcttaatgaacagtgctcttctttttcatatttagagcttggggaatagggacaaggtaaagtgggctctccagccctcaggtttaagcaagtaatagatgtcaaaaaagtagctaatacaagaagcactgattatagatgattgcccctcctttgcaagaggacgctgtaactggagtacttttaggaacaaagcattgaatccttataaaagaaggaacagcctagaggaacttaggagggaaggtgagttacaagctatacagttgcttggcagatctcatcttgtagagcggctctttatggagtgccactgccatccctgcaaataagaagtgtgtccctaggctttggagtcatggttccttagagagccttcatgtaccttcttagttctcacctacttgaacactggggacagagatagctcattgcttgtcttccctttagaattccatctgttcatactgcagggtgatcttcctccctcctccccagtgaccccttcctcctttccagaaacctgtctttcaacataaatgccaaggactatgcagtttccaactgatagcatataatttggaagcaatgtctaagggaagagctgttaggttggagagctgcctcttgaactgtgatctcaaccaaggcccggagatgtggaccagacgggcttggaattctgaaattgggcaacattcagccctatttaccaggtatgatggtatttgatgttgacagataaaaatgtacattcttttcactctctgaaaaaacaaacagaaaaacatgaccatcagtgttcactggtaggcaattatcacaaactctctatgatttctagtcttgtatagtttctaggacaaacttcatatagtttctgtgattccatgatcttcagtgttcttgtttagcctgtaattgactttggtgactctcatttcacatgtaaccttagtctccttttttctttgcagaagttctgatgcatttgtaagcccctgtaaccattgccacagaagctgaaagccttgaggtgtttagaccctgctatccccagaagtaatctcacttgactgacttctgtgcatagaagatgcccatggcttggttttgggaatgatgtcaaatatcaaatagttcatatttttttgttttgagatggattctccttctgtcatctgggctggcgtacagtggcgtgatctcagctcactgcaacctctgcctcctgggttcaagcgatcctcctgcctcagcctcctgagtagctgggattacaggcacgcaccaccacacccagctagtttttgtacttttagtagagacaaggtttcaccacattggccaggctggtcttgaactcctgacctcaagtgatccaccagtcttgacatctcaaagtgctgggattacaggcataagccaccacacccggcttaaatagttcacatttttgaccatgtgcctggtgctgggacactaacgtgtgactgatggtgcttttaaataacacatctcactagtctcaagacctgtcttggttgagggtttgctcaggaacctgacttcccttccttgttttttttctctccgtggaagtttggcagaacaccttatttaagctagaataagggtattggtaagttaaagtagtggttctcaaacttggttgtgcattgacatcacttggcgatcctcagaaagtacaagtgggccaggtacagtggctcacgcctgtaatcccagcactttgggaggccaagacaggaggatcacttgaggccaggagtcctagaccagtgtggagcaacatagggagacctcatttctactactaatgaaaattagcagatgtggtggtgcatgcctgtagtcacagcttacctgggaggctgaggcaggaggattgcttgagcccagaagtttgaggttgcagtgagctatgatcatgccactgcactctagtctgggcaacagagcaagactatctctaaaacaaaaacaaaaacaaaaacagaaacccacaaatgcctgggttccactcccagaaattctgataaatttgtctggaatgtgacctgggcatcaggatttttaaaagctccctagaaggtttgaatgtgcagccaaggttgacagccactgtgctagatgttttccccctttttcttcctaccccaaagaccaagccaatttgcctatgagttaaaaccagcagaaaacaagataatgagtgtaatagaaaagggattgtttaagaagttaaacaaaattttggatagattaggcaaaattgagaaggttgagaagagttaaaaaaatgaaagatatttgattcaactaaaagcaacaagatgaaaaaatacagaagaaaaggataaatcctgttgaatggtagagagactttatttaactatttaagaaatgaccaccaaattatcataatgaaaatttgtgagaaaattctatacatatggtgtaagattaagcaatgacccagaagtatacttctggagtagaacaatcaataaatcaattgcatttttgcttaggcctccattctgtagcctaattgtttgttggttcaatgcagcccttttgctttgatctctggttttaccatttacaaagacttgatgagcttggcttcctgtagtgaaattcaaatatacttgtgaaatgtaaacaacattcatttattaagaatcctataatcaaggcaaattggcatgcttatataagcaattagccttgagaatagaaagataaataggatgctaggtcaagaatgagctgattgttctcaatgcaagactctagttatttctttattcattataatgtaagcaaatagacattcctcttattcataatttttagcatttgtggtttggggtttgaggacagcatatgtggttttctggaactgagaggatagtagcaattattgtttcattttgatttagaaatataaatcaatcttataaggaactgtaggtagttgatttatgactagataaaactttctaataatagggaacagggcaagagagggtatggatttaaatgggaatagtaaaggataataatagttttattttggtggggaaggtaaagaagatgacaattttacagtggcagaaagattgaaaatagtctcatctgccctcattgaataaattgaataaaaaaggaataacattcttttttttattggcatagaaggaagcattatgataactaatagcaggagaagttggatatgtcatgatcagatttgcaccatggcaacactcagttttgcccagtgagttcagtactgctaaatgtcttatttgtgaaagctagagaacctaaaatgcaaaggcagtgaattgggtgaatagctttgttaggttcagttctggccctttcattccctgatatggtcacctttgttgttcttccaaagaaattttctctttggtgacaatggagtatcttgactaatcagggttctttattcccaaggacttctgcctggtgaacctaggaagccaaatgttttgggaccaggatgccataaacttggattcccagggccttaccataaagtcactctacaccaactaatttggccatccagatgcgaacctggagaagccatttagaactctgtggcctcctgggcttgtgcagcccttcctcttgccagtgtttacaccctccagtggccttttatagcagaatgtttggtttggttctcagggtccactttttggaaagcattgtttggcttagaaatctccagatcatttgtgaatttaccaggtctcatttctcatttaattaaacaagtctttaacattaaacacctatagttttttttttctttttcttctttttagatggagtctcactctgttgcccacgctggagtgcagtggcacaatcttggctcactgcaacctccacctcctgggttcaagcgattctcctgcctcagcctccagagtggctgggattacaggtgcatgcctctgtgcccggctaatttttgtatttgtagtagagacggggtttcatcatgttgcccaagctgctcttgaactcccaacctcaggtgatccgcccaccccagcctcccaaagtgctgggattacaggtgtgagccactgcacctggcctatacttttattatttcaccagtaattatcagaagttctggcagggtgtggtggctcacatctgtaattccagtgctttgggaggctgaggtgggagaactgcttgaggcctggagtttgagaccagcctgggcaacagcaagatcctgtgcctgtgaaaattaaaaaaagaaaccacacacaaaaaaactggcttagtggcacactccctgtagtcctagctacttgggaggctgaggtgggagaattgcttgagcccagcagttcgaggctgaagtgagctgtaatcatgccactgtactacggcctgggtgacaaagtaagataccctatctctaacaacaaaaaaagttccacgattgatttcctctgatgtttctaatgataatggagaaatttaaaaattctttcttggtcattttttagaatgatattacctgatcctcttttaaaaaaatcttttcatggccaggcacggtggctcagactgggtgccatggctcatgcctataatcccagcactttgggaggccgaggtgggcagatcacgaggtcaggagttcgagaccagcctggccaacatggtgaaaccccgtatctactaaagatacaaaaaattagctgggcatagtggcacacacctgtagtcccagctacttgggaggctgaggcaggagaatcgcttgaacctgggaagcggaggttgcagtgagccgagatcctgccacagcactccagtctgggtgacagggcgatattccgtctcaaaaaaaaaaaatttttttttcacaaaccagacacagttgcaaccaactcccagatcaggaatcagaatccctccctccctcttgttcttcaggagtggtgagacttggcttctggtctcccagccacagttattgctcacctgaacttactttctcagcggtcacacttcatgtggaagagagtaggccacaggattgtgccttgtggtctgactccaagtgactctaaccatgaggtttccaccacttcctttgagagcattcctagtccaagtaggcctgagcattaggaaatattgacactgcagcattttcttgttgcttttagttatatcatcattgatcaccttaatggtatttttgtttgtgtgtatagtatccctgcttttcataatactgagaagaggatattttgatttgtgttcccaaagtaaagcatgaatggggagggatggccacagagaaaatgagcatttgaaattttgggcattaatacttggaattacggatatgtaggtacaaaatttatgtgctccttctcaagtgtaagttctgacctttagcttttgttatctttcttgatgactcttgaaatattaaaaggtataagactgtgaatttcatgttctggttcaatttcccatcacagccctattgtgttattccagacattattaatagataaaatttgaggggctcatggccacgtttgttggtctctcttcttttctctgctttgtaactcctgtatccctcacagccttcttcctgaagccagctacgacttggccagacccatctcctcttctgtttctttacaagtccctaacttggaagttttttttttttctttttcgttttttaatccctgtccccagattaggcctgtgctttctctccttcgtatttttttcccccggtgattcccctgcataggatgggctctcttcgcttctctgcttactgaaactataccagccttcaaagttttctacagtcccactttttccgagggtccttacagacccacgtcagcatgggggtgatgagaaaaacaactctccttactttgatcgctttgtggtatgaattatctcttactcatgaggcacttgattaaatatcactttgtataacttctgattgtaaaatagggagatgctttcatatgtagctttgtagttgctcattacattcttagccatttgtttgtgtctttgtttcacctgccagttcacactgtgggctcctgaaaggcaaggatcatgtcttacggggtctgacagcttttacttggcttagccttgggaagggtcccagcaaatgattgctgacttgataagggaacggtgcccactgaaagaggactgggaattggagtggctgctctggatacctatttaactgaccacactaggctgactattaattgcacataacttgcctttgtgttgaaatgacacttggtcatagattcttattcatcttggtattccccttatcacttgactgtggtaggtgtccaagaatacgaaacattcagagacaacaagttggcatcatgcttccctgactccttgtgaattagcagaagaggaggagggcagtttatattttcttttttgttggagtgaggtaagtttaaatgggcagcgttctttgttttggcatgttagtgctttgctgtttgcagagtgctctccaattgtcttctgtgcttctaagggtttttttttttttttttttttttttttgagacggagtctcgctctgtcgcccaggccggactgtggactgcagtggcacaatctcggctcactgcaagctccgcttcccgggttcacgccattctcctgcctcagcctccccagtagctgggactacaggtgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccacttctaagggttttaaataaatgagacaaatagggcatgagactggatggcttgaagttatataagaaggtggtgaagtttgtgatccagtcctaggtcttcatactaaaactccggggtgcattccactgtaaactaatgatgtttatgaattctctcgagttctgttaggtgctttatatgcattatcgttgatgctcatgacaacttttccagggaggtattgtcttccttttactaatgagacaatgggctgagggtgttaacgtggccactacccaatcctgggggcagagtttgaatccaggcctgcctgagacagcctgcttctttctactgcactacactattatgttttctgagttagctctaagatgtcattaaatgtatgcttcttgttcgttcttcacataccctctgtactaaactcattatttcatacaatagctgctttgaatgagtccaacttgtgttatatgctgcaaaatctgaccttaatctcaagggactcaggatgtagctggggaaacaagcaacaataagcaacccagagagcttcataatcagtgtagatgtagatatgctaagggtttggagggaaggtgccttttctgaattctgagtgttcagaaaatgtttccttggaataggaagtaggtgagattctagctcagtcccaaccactgctgggctgcacttttcattctacattgtgcatttttgctcctttggtgcttatatgctttattcagacagtccaaaaaatatttcttgagcgtttactgtgtgccaggcagtgttgtaggcactggaggatgctgtactgaggtgggatcgattgaacgtctgctcccaaggaatttacattttaatgggagggcgtagagggggaagccagacctgaaggggatgcacaggtacagaaatggagcgtttagatggtggaaagtgccatgaggagaataaaatgggatatgtgaagtggtgtcatcccgataaggtctgagtgaggaggagcaggcagctagtgtgatcaggtaagagccctcgggagggaggagtagccagagtacgatttgtttctccgtttgctggttcaggagcagtttccagggaccctggagcaagtgaagggtcattccacagcatatgggatatactcagcccagacagcttcagaccttgcccatgggacagcctcaaggtggaggctcaggagtctgtcccctcactctgttgtcggtaacagagccatttcttataggtggttttgtgtagtcagagttctgcctcttgttaaattcaggtgattttcaaagaaatgagtatttcagaattgccattgttctagacccatgggacagactgtttgagaatggactgtttgatcagtgtgagctgtgccctaaatgcaggcactctgaaggccagtacttagaatggctttctttgtctgcttgaagctataggttgacctgggacaggcaaggtattacggaagagaattactttattgctgttaacttgctactagcttgtagctcagattctttccctctttttcttttttatatttcctttacaaaattattgtattttaaggggcatacaagaattttacaaagaaggctgggcacggtggctcacgcctgtaatcccatcactttgagaggccgaggtgggcagatcacttgaggtcaggacttcgagacccacctggccaacacggtgaagccctgtctctattataaatacaaaaatcggccgggtatggtggcgcgcacttgtagtcccagctacttgggaggctgaggcaggagaatcgcttgaacctgggaggcggaggctgcagtgagctgagatcacaccactgcactccagcctgggtaacagagtgagactctttctcaaaaagaattttataaagaggtgcaattcttaagataaaaataaagtgaaagttgtgtatagttaaaattatcccaaaaatacctgaagttgcccatgaaagtacatgttcaattctgtagtgaaacaaccctagaaagcaattattatttcttttaaattttactttaagttctgagatacatgtgcagaacgtgcaggtttgttacataggtatacatgccatggtttgctgtacctatcaacctgtcatctaggttttaagccctgcatacgttaggtatttgtcctaatgctctccctcccctttcccaccaatcccagcaggttccattgtgtgacgttcccctcccggtgtccatgtgttctcattgttcaacccccacttatgagtgagaacttgtggcatttggttttctgttcctgtgttagtttgctgagaatgatggttttcagcttcatccatgtccctgcaaaggccatgaactcatccttttttatggctgcatagtattccatggtgtatatgtgccacattttctttatccagtctatcattgatgggcatttgggttggttccaagtctttgctattgtaaatagtgttgcagtagacatacgtgtgcatgtgtctttatagtagaataatttataatcttttgggtatatacccataatgggattgctgggtcaaatggtatttctggttctagatcctggaggaatcaccacactgtcttccacaatggtggaactaatttacactcccaccaacagtgtaaaagcattcctatttctccacagcctcaccagcacctgttgtttcctgactttaataatcaccattctaactggcatgaggtggtatctcatcgtggttttgatttgcatttctctaatgactagtgatgatgagctcctagaaagcaattcttatgcgtgttaaagtttgagaacctttaagcatgattaaaagagaagccacaaaagaaaagtgggcaattctgacttagaactctcagacctctagcagtgactggaggatgggtgggaattttggtatcttcctgcttgccagtaggtttacacaattcgatatcagaataagtctttaaatacatattagtggctttgtttattgtgaggattttaaggtagccctaatgtgggtttaaatgtggatttcatgcatgttcagtaataatacaatataggtcacttgtgtatttctttaatcgtttcagtaaacatgaatggtagctcaggaaacctgaaaggtaggtatatccctgtctcatatatgagaaactcaggattagggaagttaaaaatcttacctgagaacacatatttctagtaggtaataaagctgaaaatcaaatttctcgactcaaaagccgtgctcctaacattctgttttgactcccaatgcaaaaatattatgtaaatataagctatatgtagaataaatataaatgtttcaaagtaaattgacagccttgtgatggcaagctcatcatcttttcagtctgtgttcattttgttatatacccagaaccaacagtaactacatatccttcagaaaaattacagataaaatgagaactggatgaataaagccactgttcactattgaaatagtaaaggccaaataagcttgtgatcaaatcttttttttttttttctagtaacagttgtcctctgaaggctttctgaaggctctctttcagacaactgtctctgaacctttgtttttttaaatgcccctagtaaaatggctgtgttgttacagcttgaaggctgtgtggtaagcctttgctcagccctcagtgataacccatagacttggacttccatgtgagaagaacaaccattattatattgtgttagtaggccttgtgttggagattgcttatttttaaaaaaacaaatgccatgtgatcttatttctatttaaccaatgttttgcttgagtgtaccaagcaaggcctcttgagatgctgggacacaaaggtgaattttattttcccttttgcctttgagtagttaactgcctagtagatgagatactggaggtaagagaatgaagattataggatatttaaaggcatttatcatacatatatgtgttatgtttataatgtgctatagaaggacatattaaagttgaagtttctaatattttagattaagctgataaatctagacaacttactttggctgaaggttataatacataattgcatgaattctgctctgtgcctgaatgcttagagatttgagtgtgtgtctaggtatatctgtgcaaacaacttggaagaatctggtaaaaagtattaataccaggatcagccttttaggtggtaagagaatctaccccaaaggcagtcgactctaagccttacttctctaggttgcaagcatcagaaagtaagtatatgtccctatactcactttgttagaaagcccacagtcttttctgcaaagtctatttaacaaagcttgtttatgatcttggactttggactaaacctgagtttgaatcaggattttgctgcttactaattgattgacctttctaagccttggtagccacatccgtcatgagctcaagagctacctttttgacttgttatggatattaagtgatattgcttagtacagtcaagttgtggcagtcaggtaagcacctcacaagaagtggttgttctgattattttgtactcttttaaaatttgactttattaaagcactggctttagggtccaagctgtggactttaactggattctagtatattttacaggtaactttagttaaatcatcatcaacctcaaatgtgaagaacaagtgaagcagggcccccagaacgcccagaattgaactaatggtggcttgtatttgctactcttgccataagattgtacctactgaccttctgtgatacatcagtgttttcaaagttctggtccatgcatgcagccccacttggatttatgttgactcttgtatattttgttctttctagaaaaagagacccaggtgtttcagggcattgggctattccatttcagagcctaatggaagtgctagtgttttcataattggaacagacaactgccatgctacatatggtgctgtgaccactgagcagcttgttcacaatgagaaaatacattgaagttgtgaccatttgagccttgaagaaactgctgttgaagttttgtttggctccagctccatcctggaatggatggagtcatttggaattattctgaattccagtagtggcaaaaaaaaaaattgtgtaacttgtatatagatggttttctgtttgattaacagcattgttcaataaaagatgcattgttttaaatcaagaatacggtgccatctgacttgatctaggaggcacagaaagaagacattacagattacattccccagtaaacccctgcgttattttttccagaaggttctatattaatctgtttgggttgcgtcctacgtgatcttgctgagtcagacagagctaagcttatgaaacaaaggctagtcccaaatcaaataaaaacacaccaccatccagaaatgagagcctagaattttctaaagatgcacacatctttcttactatctggtgaggaaaattgctcatttttctctcagctgataaatatcacttttgccctaaatttttgtagtggcaatctacttttttaagttggtgagataaaagaatatttgatagcactgtcagactagtctgagataaaattctctgtgttctcagacccttaagggttcttaaattgcatgggcggaagctgtgtgcatgtttttcttggtgccctatttccatatcaaatagccttaatttttgtattttagtaatgaaggtatgaacccattctgtcaggcttcttatgccgtttattgtagcctttagtcagcttagaatagcatgaaaggaagtaataagccaactctaagaaggtccagatgaaaaggattataatatggtacaaaaataatagcatgcctggcctagccatgtgactcatttcttttggagtattccttttgacagcttttttgaatcacacatcaatcacaatgctggtatttttggcggggtgctagacgttactctaatgctcatgatggtaactgccaaaagtgaacaaagaggagaattataaatgaaacctaacagcatcacaaacatttattttttcttgagcagaaacaaaattgggagttagatgatatctttttcattgccccaagaaaaccactgctttattccattgaaaataagaccttgatgggtcatccccggtctttggcagtagaaactattcgtcttgtcttggtttccattcaggagctttccttcccaaaccttgtcccctgctttaggagtaatttttttagggctttaggtttttctcatgtcccagtgactaagcttgcttttgggtggttctctgtgctgcatgtagtccttctgggaagaaactcccatgaagttcaaaggagcagcagatatgcagggtgcatctagaaatgaaaatctgaccctttgtccctctccttttcatctctcttttgtacaggccttctttccttctgtgcaaacagacccttgtcatagtcatagtccatcacgctgttaaatgatttccagcactgctctatgatgtgctgtaatttcagggagtagttttattttctacaacatgttgctctgtagcacgtgtatttcactactgagtggtagttctaatggacatattcttaacaaaatagtcccagcattacagaatactaggttagaatacatacccaaataaataaaatgttacagacacagtccaagctcgttctctcctgacttcctttctcccgctacagaggaaaattaccccgaattggcacatctcattcctatgcactcttgttaaaaataacttatagtttgcttctgaatttatagaaatggcactataatccatatgtacttttgaatctttatacatttgatttgagaagtatttatgttgatgcatgtggctttaggtcatttattttattttgtttatttttttgagatgaagtctcgctctgtcacccaggctggagtgcaatggcacatggcaacctctgcctcctgggttcaagcaattctgtctcagccttccgagtagctgggattacaggtgtgcgccaccacgcctggctaatgtttttgtatttttgtgtagacagggtttcaccatgttggtgaggctggtctcgaactcctgacctcaagtgatccacccacctcagcctcccaaagtgctgggattacaggcgtgagccaccacacccagcctggctagaggtcatttaatttttgaattatgttcattgaataaatgtgccataaattacagttgatcctcattatatgtgaattctggatttgcaaatttgcctatttgataaaaatgtatctgtaaccccaaagttaatacagtgcttttatggtcactcacagaccacaaagtggtgaaaaatttgtcaccagatgtgcagattctcagctgaggttgaacaaggtgactctgcttttttgtttcagcatgcatactgtacacgtgtatcctttttgctttctatttagtgccacactttttgcacttttgtgcttttttttttttggtgattttgctatttaaaacagacttcaagcataatgctgaagtgctgtccagtgttaactaagtgcaggaaggctgagatgtgccttatggagaagatatgtatattggtaagcttctttcatgcatgaatttagagagctgttggctgtgaggctgtgagttcagtgttaatgaatcaataatatatattaagtaatatatataacgataaatattaaataagtttaatatataacgataaatattaaataagtttaatatataatgataaatattacataagtttaatatatcacgataaatattacataagtttaatatatcacgataaatattacataagtttaatgtatcacgataaatattacatcagtttaatgtatcacgataaatattacatcagtttaatgtatcacgataaatattaaatcagtttaatgtatcacgataaatattaaatcagtttaatgtatcacgataaatattaaatcagtttaatgtatcacgataaatattaaatcagtttaatgtatcacgataaatattaaatcagtttaatgtatcacgataaatattaaatcagtttaatgtatcacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataacgataaatattaaatcagtttaatgtataactatatattaaatcagtttaatatataaaaataaataagaaacatacatagcacagttttatgtattgatcagttgacaaaaatgttgcaaccagaggctctggggagcctaaccgtgtatttccgctagaactaatggttcaatggtcaataattcagtgtccatggtgactttatagaccataactgtgatggttaatatcgagtgtcaacttgattggattgaaggatgcaaagtgttgtttctaggtgagtctgtgagggtgctgccaaaggagattaacatttgagtcagtcaactgggagaggcagatccaccctcaatctgggtgggcaccatccaatcagctgccagtgtggctagaataaagcagacagaagaagatggaagagctgattcactgagtctgctgagtctgccgagtctgccagccttcatctttctcttgtgcccaatgcttcctgccctcgaacatcagactccaagttcttcagcttttggactcttagatttacaccagtgatttgccaggggctctcgggcatttggccacagactgaggcctgcactatcagcttccctactttagaggttttgggactgggactggcttccttgctcctcagtttgcagatggcctattgttggacttcaccttgtgatcctgtgagtcaattctgctaataaggccaggcgtggtggctcacacctgtaatcccagcactttgggaggctgaggcgggtggatcacctgaggtcaggagtttgagaccaccctggccaacatggtgaaaaacccctgtctactaaaagtacaaaaattagctgggcatggtggtgcacacctgtagtcccagctacttgggaggctgaggcagaagaattgcttgaacctgcaaggtggaggttgcagtaagccgagattgtgcctgggtgacagagcaagactgcatctcaaaaaaaaaaaaaattctgtgaataaacttccttcatgtatacatatatcctattagttctgttcctttagagaaccctgatgaatacaataactactgcaaataatgggagtcaactatctcttgtcatattgatggacatatgaggttattacaagtaacgttacaatcaaaatccttgtctatgtcacctgatgcacaggtataaatttcttaaggttatatattaacacttagaagtacaattgttgggtcttgggcatattcaacttaagtgattagtgttgaagtgctttctaaagtggctatatttccttgatgaagttggtgttagagaaattcatccccacagtgtacacagattgtacctacatattatgaaattagcaaaaaatttttagtacctacatggcactagatgtgagtactaacagtgagctgccatctaggagcttacagtgtatttccagtgataagttttacaaacataaataaaattattaatagttgccatccattttaaactttacctttgagatgaatatagattcggattgtttgtggaaagcttaatataatagcagctaatatttatagagtctttttttgtgcttttaatgtatttaatcttaacaacaacccaaggagataactgtaattaattccatgtaacctaagaggaaatttaggtgcagagtttgagcaacttgcctaaagtcacacaataaatgacagagtcaggatttgaatttgagtcccctggctcctaagtgcccaatcttaattgttgtgctatatattcatcatttaatttcacagttgtagccgttatctaagaggtagcctttttttttttttcacataacaggtaaaaacaactaaaggaactagggagagtcaggcattaggaagttaagtgtggagttgatttttttaagctggggcagtggtgagacagaacatacagaggatcatcttggcttctatactgattattcaatctgtctttgatcttttggtgggagagattcttagtatccctgtgtttttcaccaccctttacaaagccattgagcaattttggaagaaggggaaaatttgtgtattctgtttgtcctggtttatttgctcaaatgggggtttctctacttctacaagagttgttttaatcttcactactttttgagggcttttactgtgcgatgtttcatgtgtatttctcagaacaatcctacggtatttagtatttacttagcaagtagttgagggattttggctggccactctgacgtcatttgaactaggcacacattcaactactctgtcctcttttgtcgaagatagtgagagtggagggcctggagtagatacaagttgggaaagtgacatccttcaataacaagcttgtaggctgtaaaccacaaaggatggcttattgaaatggaatatcactattagtttctcattatcctgtcagaaaagagaaattgcaactaaagcataataaagggggttttcgaagccacaaaccgcatctttgctcttcagatgtatcttacttgttgaatagtaagtgaatgagatttatgaaatgttcatagtaagatgactgagaacaattgtttctccattttttagaatcagttgcttctttttcttttttcctctctttttctttcttcttttcctcttctcttctcttctttttcttttttgacagagtctcactctgttgcccaggctggagtgcagtggtggaattatagctcactgcagcctctacctcctggcttatgtggtcttcccacctccgcctcctgagtagctgggactacaggtacccaccaccatgaccagctacgcttttttttgtttgtttgtttccctattaacagatggtctgtatgctgtcttctgaaagtaaatactcatggcctactctgaaggaattaagattattctttgaataattgacagcgactggtgctaaaatatattttacatttatggcccagtatatataagttctgtatattcaaaggaaatcaaaacaagcttcataaaacaattcttatctttatatgtgaatggtattgcattttctataccattctattcttttaaaacatgttggtctgacttattttaggtggaaaagatgtactacatgataattaaattccagaatttatttgtaatacaatattgaagcaacctggtcagatataatttaaactctttgctcataaagctcacactgaagaaagggtttactctttggatttgtttataagacttcttaagtcttgctgagttgccaatatctattccttgtagtaattgctaagattggaaacatttgctttttcaaatttttgactgcataataaacagtggggaataattaagactcaagaagatactgagaaaagggctaaattttagcaggcatactaatatatttgggtctatagtctcattttttttccaggtaaaagcatttatatggaaagtactacatttgtaaaaggcttttttttattctttgataacttctaatgtgtatctcttgagttttgcatatgttgtgagaacttggataatgataataatcaatttttacaaacttctgtttgaaatttagtttgatatggtcaacttaatttttactcacttgaaaacttccagtaaaatatacatgaaaaccaaaaacacagggcagccttttggggtgtgtgttctaaattgtggcttatttctggggctttttatattgtttcaatatactctttcaccttgctaataactttatagataattatccttgtttattgtctgtttctacctacatctgcgcctcttgacttcagtggcaaaataatatcacaacagaaggtggtttgatattttgtttctaggtgtctacattttacatggtaggccacacaagatagcatcattctcataaaatcatccattttcttggttttagctttctgattaacagtttaactatgaaagctggaatgacttaaactcaggggttttaatccagctttgccagccatgtccttaagatcccctgcattttaaccccaccatccgcaaactagattaactatcactgttaccgtcttagagcattgatatgggataaatcctccaaagggcttttgagggaaatgttttatatgtaataatgtgggatgaggaatatgaggaattacactcattttagtcttgttactataaagttatcaaacagaatatgacaagttacactcaatgccaaccatacctataaatactttttttcccattagtacacataatatattctcattgtagaatattagaaaacaattaggaatggaagacaagaacatttctaattacaatgcccagctataagcactgttaatattttggtatgtattcttccagtatggttttgtttagctacatgcatccacatcatgaacatactttcatatctttaattagaacttttgagtgtttgcaaagtgttacactaatgagcatttcagtttaactagttccttattgtttgactctcgggatggttgcacacttgtgttctgaacatacttgtaactgagtcttgacatacattctaaatcatttcttaggatgatatcaagtacagtgtaaagagtggtgaaaaataacaaaatgggcactaggagaattagatgtaagttttaactttgcctttaattgttgctgaaacttttaaatcactttcttcgctgggcttcatttcccttcctagtaacagaggtaaaatggagtaacccctgtagaggatttaattctgactgcaaaccatttgagatattttatggataaggaaactaggactgaaaaggactctagtgtctctttctctatgtttgaaggttttatcgccccagtcccccaccccttgcttgcttttttttttgtgatagtgcagaaggtcctgagtgccttgtggttctttagagtcatggtcataatcatccataatcattgattattgattaatggtgtctgaagctgattctattttgacttaaggagacccttttatggacaaaatatcacttaataccttattaactttaactgtttccttcaaaatcaggagtcccagcaactgatgactagataaaccaaatgtagtatatattcatacaatgggatattatttggccacagaaaggaatgaagtgctgatgcatgctacaacacggtgaatctagcaaactacgctatgtcaaagaagccagtcacaaaagattacatattacatgattccatttatgtgaaatgtccataacaggcaaaactatatagagggaaagtagattagtggttgcctagggctagagaccctgtgaggattggagtggttgatagctgaagggttcaaggtttctcactgaagcgatgaaaatgttctaaaattggtggtgatggttgcataactctgtgaatatactaaaaactgtcgaattgtgtgcattacatgggtgaatcatatgctatagggataactcaataaagctgttgtccccccaaaacaaaaaataatccccaaataatcacactgcaaatgattctgaaaaccttttgtttcaagtttctagatgtttggattataactaaatggaaactggtcatattaaactccttatgtgttgttagtttgtttcctgaaaatcttagtttaaatcccaatgtatgaggatgactgaattctattttcgtttggagtttcctttggggacttttactaagatacttgctaattgcaacaatttatgatctctctttctcgtttctcagtgtttctgaagtgctttgtagaataatcggattttggtatcttcagtggcaggctcagtgagtttttttcttttcttttttttttcccccccaagacagagtctcgctctgtcgcccaggctggggtgcagtggtgtgatcttggctcactgcaacttccgcttcctgggttcaagtgattctcctgccccagcctcccaggtagctgggattacaggcgcctgccaacatgcctggctaatttttgtgtttttagtagagatggagtttcaccatgttggccagcctggtctcgaactcctgacctcaggtgatctgcccaccttggcctcccaaagttgctgggattacagatgtgagccactgtgcccgactgcagtaggctgagttttctacttggtgtctggcacctgctagacaatactctacatgaatattttttgctatagcagaccccaaataacttagagttaatttgatttttttgttgttggtggtggtgtttatattggaattcatggcactgagttttgttttatttgcctgagtgtattcttgagttgctcatgaggtagttgcctgagagcctcagatactcctctattgggacacttcttctcttagatatattaattacagacaagtgagttgagccagagaaagcagaagtagggttaagaattgagtgtcttggaaatccagactacatttggtcattttcaatgaaattttcacatcctttaggagtttcacatccgttaggaggtttgtgtgtttttttttttttttttttttttttttttttaccagatccttagatattaaggttaaaatttaatcaacaaattttgttttttatttacagagacctataggatacacatggagttattaaacctaaggggtgaatgaaaagaaaaatgttggcagttctatcttaagtctttattgcctgcctttgcatgttgtcatgatattagccagagaaccaggcttttaaacccaaacattagtaaaccgtaaaacatatcttgagacaatctagtgcaacaagagcaaatttggcagaatttctgaagcgattccatgaccagtatttccaatacattaatctatttagatatgctttgggtacttttcctggcaaaatggtaaattgtgcaactggcgattaactcagatcttggaattagcctgtgactttgatcttacataaataagtttcctcagtaaagtttttgtttagtatctgaaatccagcttttttcaagagagcttttagctggactatcttctgtattgatactgagaattcagaattctctctcatgagtgaaatttgttaataagttcttgagagattgagaggtcctgtccttctgtctagaacacccctcctgcaaaccctaaataatgccttagttaagctgaagattcggaaaattgagatataacatgaagtaaaagtatttttgaagtcttttcaatccacctatgtattgcacacctgtgtgcccagcacataatatatgattatccatttagtgacaatgtattgggtgaccatggtgtgctgggtactgtattagagtataaagagatgaaaagacaatgtctttatgtagttaatgctataataggaatatgtattaaatgggagcctagaggtgatacatgctctttggaggcagagattgacgaggaattagaaaaggaacttaaggagagttgacttgaattggagagtggaagatgaatgtaatggcttggaattgaggagaggtggggagcagttttgggaggaagtcattctagggaaaggcacggtggtatggtgtgttttgaaagactgcatatagttgctatggctagaagaacatagtctctgtggatatggcaagagaagttgtggtcaaacttatgttttagaaatgttatttaggagtaatgctgggatggcttagagtggacaaagacagcccaatcaaaagtctcctgccatgaccgggcgtggtggctcatgtctgtaatcctagcacttttggaggctgaggtgggaggatcacctgaggtcaggagttcgacaccagcttggccaacatggtgaaaccccatctctacaacaaatacaaaaaattagctgggtgtggtggtggacgcctataatcccagctattagggaggctgaggcaggagaatcgcttgaacccgggaggcggaggttgcagtgagccgagatcacgccactgcactccagcctgggcgacagagcaaaactctgtctcaaaacaacaacaaagtctcctgccataatcagacagtcagcagctatgagaatagataagataggtgtctggaagaatgaagaaagggagaccgagaattggtgcctcaaaagaaaggacaggacttggattcaaattgatccttgtttgcatcagggactcctgagattcttatgaaaaccatagccaagtgcatatacgtatacccatgtaaaaattaacatgtagtagcagaaacccattcacaggctttcagaagtcatggatcccaggtttagagcccttgatctgtagaatgatggagagaaaagagtcagtaacctccatgtttactagagcccagaaatttggaagattactggtgcagccgacagattgggccagttgggtcatagcaggcaagatgaatacaattttggatgtattgagatttccccataagaatgagaacagtgaattgaacaatgagaacacgtggacacaggaaggggaacatcacacaccggggactgttgtggggtggggggaggggggagggatagcatcaggagatatacctaatgctaaatgacgagttaatgggtgcagcacagcaacatggcacatgtatacatatgtaacaaacctgcacgttgtgcacatgaaccctaaaacttaaagtataataataataaaaaaataaataaaatttaaaatgtttgccaacaacaacaacaaaaagaatgagaacagtgcatttgcctctgctgaagtgcttattgaacacctgtgctaaagagctcctgatgctggattaattataataacatacacttgaccagatgcagggtctagataagcaaaaataaatattaatcctactagagctgtagcttgaaatgtagtgtaccctggtttaaaatgctgtaaatggccaggcacagtggctcacgtctgaaatccccgtactttgggaggccgaggtgggtggatggcttgagcccaggagtacaagaccagcctgggcaacacggtgaaaccccatctctagaacaaatacaaaaattagccaggcttggtggtgtgtacctgtagtctcagctactcagggtagggggctgaagtggaggattgcttgagcctcggaggttgaggccttcatctgaaggatggaggtgagccttgattgcaccactgtattccagccagggcagcagagtgagaccctgtctcaataaataaattaaattaaatgctctgagcaatggttttattttgcttctttagtttaggaggctaccctgttattgtgtgtgtgtgtgtttgttttttttttttttcccagatggggtcttgctctgtctcacaggctggaatgcagtagtgtgatcccggctcactgcaacctccgcctcctgggttcaagcaattctcctaccttagcctctcgagtagctgggattacaggtgcctgctgccactcccagctaatttttgtatttgtggtaaagatggggtttcaccatgttgaccaggctggtcttgaactcctgacctcaagtgatccgcccaccttagccttccaaagtgcacatttagtaggcattgacagtgttaatctttgagtggaaatagctggagaatactccgaataaggctgaaaaaatgtgggattatcacatttaagagggccctgtttctatatacttaatgcttttgcactgaaatgtttgatattttagttgacagcgttcttaagcaataattttggcatcagagaagtcacttagataatttcttggatccccatgagcactggtaatttgtagaacaggttgaaaggggattgtgaaaatagtcagtcttaggtgtgtgaggtcatcttgtctcgcttcctctccaccaggttaaaaccacacctcagggctccaggaagctgactgagcacgtagtccaaagaaattttgcattctggtatttttcagtgttttcttgtgattttcatctttaagctaatttgttgagaagggcttataggatttgctctctttgggcaagcttcctcatcagtatcaatggctgtagtcatgcagtcctgttgtgaccatgttcaactgaattgacaactaatatgtatcacgccacaccactctgcggttttgccctttgtaaatgttggcttcatctgggaaattgttagaaatgaagattcttggttcgtgttcttgacctactgagccagtctacgtattaacaagatctcacacgtgactcacgtgtgcattaaaatctgagacttactggactagctcaggaacatggcctctcagagcccttttgctgaagttcaaggctttttctgtttattttctcctcagaagtgatgagaaacatctggtcaccatctttcatgcagtatacattttcatggaattaaagataatgatttaggtgcctctaagctgtctcttcttcaagcttaataactgaagtttgtgtgatctctttcttcatagagaagatgatcttttagcctttcatcctttattgcctttggtctctgtttcctagataagtttttaaaaaacgtcatttctgaaatgggcagaatactcttatcagagtgtggttgctactaaataagcaaaataacttaacccatgtattttttaagatctaggggcatttggctaaattttttgttttattttaaaagtttttttttttaagcagtaaaaatagcaactaattcttccttgagggaacttcaaacccaaaaagtacctcctctcttttctgaaggatggaataagttgaccaatggtctttggcattcttttgggttggtacttcaggctaattttacaatagaggaaggaatgatggaaagagggaaagaagtaaagagagaaaggaaagaaggagggagagaaagggggagcgaagggaaccagattaataattcaaagcagaagagactattaaaagtcactcaggtgggaaatgagaggtttatttttggtgactgctttacaaatgttttggttttgggatgtgaaggagaattctttgaactattaacatttttttcctcctgacttttgaaggtcagacttttatccaccttttgcttataggaatagttcaattttgcatggaattacatttgtggttttttgtgtgtgtgttttttaaggcatcagggttatatctgaatcatcatcttttgcatgtttttagtctggacatcttttaattcagtgcaagttgtagctctgaatgagatgctccttagttttctgcaataaagcatccacctgagaaagggagagtagtctgagtgtaggatcttctaaagtgattcttaaaatcatacttcccactttgttttaaaggaagaatgtttgtgcagtgtcaaaacattaaaagaactggagaaaccttggcatattcagcattcgctgtatcatcttgtcacagcaggaggagacaatagtggctaattcactaattgcttcctatcacatttacacaaggttgtagggtcagcattaccttgctgggttgtaatttaatgagcccaaaaggtttctttatcttaaatccagattagtcacatggctgattggcaaataaaacttgggcaagtgcttgctacgcagttaaattacagtctattgaccttaagtatggctttcattaaacagtaatgtacttgcttgatgccctgcctttggtatttcattttattgagtttgcctgaatccctgctaatcctcaaaatttgtgggtctggtaaggctgttggctgaatgaagagggtagaggtttattggtgcacttactgcgtgccgattgtctaggccactgacacatgcaacttagcctctgtggctggacatgtacatagttaacagtaaagcatttctctctttccctagacaggaccatggggtctgagttagtgtgaaagaatgcaaggatgtggaaatttgaacctcagggttgttcttactgctgctgtgtttcccggaaaacagccattgacttttcttctttctttttaacatggggaaggcatttatagcataatggagtattgtttgattatttatatgcatttccttgggtctttttgcttttagagttttgttgatttgttctttgctgtgtattgtggggaatagggtatgtgtatttgctgtgtattgtgtggggaatagggtatgaagcctatagggaagaagggtggatggagaggcactaaaagtacagggatttgacttattttaacaagaaaaaattctgatgactaaagataatttgtgaacatgtagttatggcttcataccttttgtcttagttcaggctggtataacaaattagtgtagatgaagtggcttgaacaacaaactttgatttctcacggttctggaggttgtaagttcaagatcagggtgccacccagtatggttgggctctggtgagtggcttattctgggttgtgtgctgctgatttcttgtatcctcacatggcagaaagagaactaggaagctccccggggtctctttttataagggcactaatcccattcatgaagactctgctgtcatgacctgtttcctcccaaaggccccaccttttaataccatcaagttgggggctaggatttcaacacatgaatttgacagtgggacacaaaaattcagtccatgcatcccttcaaataatatgagcttttattaccattaggaggactacattgattgagttgattggaagtagattttcagaaatgacttccagttatctattgatactataaacaaggtggtatttcattaatgataggacctgtgttggtcccttaggaatgatgcattctttgcagagaagagttgatcaaggtgagtcctgttacttgaacctttgtgaaggacaaagtaaagaatcatcccaaaacaggaaatgccacacttttatttcctgaggattgagttcatcaggaaagatataatagttatctcttgttgtgtaaacaataacaaactactgcaaagctagaggcttaaaactatggtaaatatttattatctcccagtgtctatgggtcaggaatttgggtggttctgccttagggcctctcacgaggtcgcaatcatatgatggcttgaccgggccacggggatttacttcagaggtgtctcgctgatgtagttggtaagttgctgttgcctaatgatgtgaagcctaagttggtaagttgctgttgcctaatgatataaagcctaagtgccactccataaaggagtttctacagactgcatgttaacacagcatggcatctgggagcaatctgagagacagcaagatggaaactgcagtggattttattccctagcttaggaagttctttaccatcactttccaatattctgctgataacacaagtcagccctatttatcatggggggactggacaagggcattaatatcaattggctaggatcattggaggctggttgtaccacaaaggacacttgattggctttttatctcagttgctttctctaatgttgtcagtgctatggtttgaatatttgttccttccaaaactcatgtcgaaatgtaatccctgctgggcgcggtggctcatgcctgtaatcccagtactttgggaggctgaggcgggcggatcatgagttcaggagattgaaaccatcctggccaacatggtgaatccctatctctactaaaagtacaaaaattagctgggcgtggtgccatgtgcctgtagtcccagctacttgggaagctgaggcaggagaatcgcttgaacctgggaggcagaggttgcagtgagcagagattgcgccactgcactccagcctgggtgacagagtgagactctgtctcaaaaaaaaaaaaaaaaaaaaagaaagaaatgtaatccctaatgtggtggtattgataagtggggtcctgagggttttgccttcatgcatgaattgatccattcatgaattaatgggttatcatgggagtgagactggtggttttctaggaagaggaagagagacatgagctagcagacttagccccctcaccttgcgatggcctgtaccacctcaggactctgtagaaagtccccaccagcaagaaagccctcaccagatgtgggccctccaccttgaacttcccagcctccataactacaagaaataaattccctttctttataaattacccagtttcagatatcttattatgagcaacagaaaataaatggagccaggtgacactacagcttctttaagctcacatgtcgggtgtagtatatggaagataagagtcctcaatttggtggggagaaatcatacatctcagggtaaggatttttccgttgctaataaaggtattttagtcgatataaatacaagtactatttggcatgcattattagcctgttacctttgttgagcactaagagtactctgtaggtaggtaaattatagttagaggtccatctaaggagagtctaatttagcatttgtgtcagatttatgtttcctaatgtgttgattatatggaaggttcttttggaaatttggttagttgcctgccttcagatagctacataaattgcacagcatgcaccataggtgcattctttatatggttcatgggaggatttggtttatttttagagtttgacatagggttctttgggagaaagtttgttactgcatctgggaaaagatcctcttggtgatgcatcttcatctcacccatttattcttgggatgctttctgtgtgttaatggagggttttcactgcattgtgctcatgaagggccttgaactccccctttgtgctttaaccttggcagggtctgtatggctgaccttgcacttctgagaacttctctgcagttccctttgggcggcctgaacattggctgtttaataccaattaaaagcaagggctgttcctctcagtggattgctattaattacagcccgtgttccagtaatctgagacagagcagcttcctctggtttcattgaaggctactttagctctctgttttggttggctgataaaaatctgagaggcacatactgatttggaataggaagagtattctgaccccaagaagaggtatctgggagttggaagatgagtgctctgttcttatcgtgtctttgggttaggtggggcatataagggaacatggtgaaatcaaacagtcctggacccatgtcagagatcagggttctagttccagccttaacactaacaggttgtgtaacttggaactaatcatttcatctcttcctataccagtttactgggtttaaacaaagttatcttgattgtcccttctgtgtctaaaattttgctaaaaattggttactgttcttataaatgatatgaaatattatgagactattcaaggttaattctttaacttgagattttaagaatcagttttttaaaataagtttttttgggcatttaatggtatgggtgaagtctggtggtccctgatgattggtttagttactgggatattttctccatgaacagttggggggagttttagtttgtgccagaatgtagatagaagggtatatttgggtttggtgtttctgaagcactttagttcaatgagattttgaaggaaatccctggatagagattatagtcatcccttgggttctgggggattggtctcaggacctcctgtggataccaaaatccatgggtgttcaagtctctgatataaagtggcatattgtttgcatctgacccatgcacatccgcccttatactttaaatcacctatagattatctataattcctaacgcaatgtctacacatcacttcattcttgtggattcaacgtagtacttggcatgtggcaaattcaagttttggtttctggaaccttgtggaaattttttttttttcctgaatattttgtatccctgctttgttgaatccgcagatgtggaacccatggatacagaaggctgactgtatttttttttttaaactctcagaaatctgggatgtaagagttcaactcgattcatgaagcataatttattactattttttttttgcactagaaatcagaacacattaatggttgaaggttttttggctttgagaagaggctaggaggtgttctttgcatacaaaacagtagattttcctgtatgttgtgattggttatatgggcagaggaaaagaatatttgaaactatggttgatctgtgtaattctaggcatatggaggctttgcctttaggtacttttcgccttcagactgctcttaagggtaggaaacatctcagttatgtatgtaataatcattaaatgaatgttcccaaatgaataaagagacttaataacaggtgtagcgttaaaagagaggctgcaaaggggaatccttcaccctaaattccaaattccaaagtggaagaataaccactctggggtgggagtgttattttctcaagtgctaaaagggagatatgaactatcctgcttggcctgtgggagagggtcatggttattagggttgggtaatatttttgttacaaatgtgtagaagaatgtcattaattgtggcctttagcacgcagattttcttgatcagataataccttgacaactccagacaagtgactgctaatcttgtgtcagttgtaaatatgtgtttggaaggtgatattgaaccagtgggttatttcagtcaagatgtttgaaaaagaggtatacatcaaatgaaaatgacgcggattatggaaaagtcttaattttaatggcttaaaaaaattctgcattaaacccgaaaaactagagacatagaccagctgggaggtactatgagaaactgctttacaaatgattttctgtggaaccctgtcaccagcatttagtgaaacatgctttccatttgaatatgcatttagatgaggccaactggctgctagatcatcgtctaatgggcctgtgatcccacatgaagattattttccctttggtcctagaaccactctccatcctgctcacccttatagactatatgagagggtccctaggtctcactttcaggtgggctcagccagtggaaatcagagaggtgtgagttcgtggtatgtattttgtccctgctccctgctaggctgtcctgatgcatttagactgaggtggtcactgcttttcactggtgctattgaactggaactatagtttcccattggtgagatgttgttactacagtttttcacatacatgtatatttcacatacatatattttaattttttacatttattgtttctccagtgagttaaagccttagaggattgagtttacttttagcacctaagaatactactaccttttcatggaggaagatcattgaaactgtaagagtttgcagttacagaagcagtatcctctctggagcactgaacaggtgttgggggccagaggattcaagccctgtccaccattccctgctgagcaccttctctaccagcagtagctcttcagcctctgaaggcatggcggaggcctggagtagggccctgccaaccttgaatgctcatgcctggtaggttatgaggattaagttacataagattgtatgtgcttaaaataggagttggcatagaacaagtactccttgattttgatctggtctaattcattcatatttaggatgaaaaaatggtagcaatgttaagtttaattcagatgacaagacttactaaaaggtctttctgatacctcatctatacatatagtattctactctgtgtagatcatctaaaatttctataagttggagatgatcttggcttttctgttttaagattacaatgaaagacagtgaaatctgcagctgaatttagggaagactccttgaaaacatcatcagttggctttctcatttggaatacaaatggacagttgtatcctcctgccattgctttgttatgattatctaggagttttcttatttttttaaaatgtgactttatagacatttcaagtactataacatttagccattgaagctctctctctctctctctctctctctctatatatatatatatatataattattattattttttgagacagtcttgcttagtcctccaggctgtagtgcagtgatgtgatctctgctcaccccaacctctgcttcccaggttcaagcgattctcgtgcctcagcctcccaagtagctgggattacaggcatgtaccaccacgcccagctaagttttgtatttttagtagagacggggtttcaccatgttggccaggctggccttgaactcctggcctcaagtgatccaaccccccttgacctcccaaagtgctgggattacaggcatgagccactgtgtccagccactataattgatttttagtaaattctgtggaatatacagcattttatttttcgattcatcagttggtggacgtttaaattgcttctactttctggctattatgaataatgctgctgtgagcattcttatacacgtttttgtgtggacatatgttttcttaggagctactcttactttgttgctagctgaggcttctaggactgggatccttcgaacactgcatgtacctataatactcttggaggagaggaggattcctctgaagtcagaaatatcctccctggagaattctgcaaggagttggatggactcattggggccgaggaaggagctttgagccagggatgtctcaggaatgtgagagttgaagcacagctgtgcagtgtggccttgggcaacttgccagctgccttacctgtagggaaagggtgatgttactactgaaaattgtgacctcctccagacaccagtggtgaggattaattagtaaatgttggctgtgctaagcttttcctttggctcttctttattctcagaggcagccctgctttttagggctgaaggtagtaagatctgtaagaaaaagccagagaaacccaccttgtcattgctttcttgggaattaagggttatcttgtgtttggttaggacaccagttagtttccagcattctcagtggaggtaatcagatcttggaaactttgagggcatgtgatcaagcaaacaacaaaactctgaggattagaggactgatagagaccctgtgaagggttcacctggaaggaggcagtatggtggtgtggaaacaacctgctttgtggagtcacatagatctgggatggaagcctggttttaccaatctctctcgagttactgaataggaatagtgatgaccacttgtcagaattgtggcagggatgaaatatgacagcaattgtaaagaacctgtcacagtggctgacatactgtagattatttgtgattattcatttcctttttcatctggttcattgctgaacttctaggcaaactgccatcttacagagagactgggatggagggcaagcctcccttgtaactgttggtatctatttgattttggacaagacttccctttccttcactagatcttgaaagttttttagtgtcaaaattctcagataagcatctcatcttatttttagacatgtaggagttagtctatcctcttttaaagagttcttgttgaaagttaatgcatttattttttatcttctatagtttcctgttcaatatggtagcaaccagtcatatgtagctattgaaacgtaaattaaatgtaaataaaaaattcagtttctcagttgctctagctacattacaggtacacaagagctacatgtggctagtagctactccattggacagtatataggatagaacatgtatgtcatcacagaaagttccattgtacagtactgctctatggaataagactctaaaaagtgggagtttcagtagaagcttattcttgcatttgtatgaatctgtctgtggctagaactctggcatcccattacttgggattgctaaaataatcatacttgcagtaatgacccactgaggcccttgtttctcaagtagtcttaaagttttgaacttaaagataaaagatgggctgggtgtggtggcttacgcctgtaatcccagcactttgggaggctgaggtaggcaaatcgcttgaacccggaagttcaagaccaccctgcctctactaagaacacaaaaattagccaggcatggtggcacatgcctgtagtcccagctactagggaggctgaggtggtaggattgcttgaacccgggaggtggaggttgcagtgagccaagattgcaccactgcactccagcctaggtgacagagtgagaccctgtcttgaaaaaaaaaaaaaaaaaaagttaaaatataaattcagcctgtgtttactctgcaaacaatctcaccagctctccagacctctaccaagtcatagggactgccttgctttgaggtgaaagtttatatgcaagtatctttttaagtaggaccatttagaaagaatatgtttgaattgagtttgctctaagtaatgtttaacactttaatatccttttctatttatgggaatataagctaacagcatttatactttattttcagaataccagtggttttcttagctctggaagaactatatctttagatcccaatgtagacttaaattaaataaatccgtttggctggcttcatctggatacaaatgactacatatttgtaataggtacttgatttcatgtttaacttacttttctgtttttcctctgtattttgttttcagagcattgagttagcaatcagaagaactaatgtttattctcttccaaatccccttcttgctttcttacttattaagcattgtctgtgtgatttgcttaggatacaaaaaatgatcacaatgtggttttggcttaggaggggctcatgtgaagtggtccatgacctgtctgccttattgctttgttgatgggtttgatagaaggttaagtgtgaaatgctgtgtagacagctcattgttacacaacatctgtattattagcatcctttttaatgagatagatggaggtgtgggctatgaatgagattcttcatggcgtgagttttctggcgggattttttaagagtgagaagaggtgtgccttgaagcaggtaagtaggagaacctactccagatattgagagggatggctagagaaggactgaatagaccagctgcaaaaaaaaaaaaaaaaaaaaaaaaaagccagggcagaggaaggaggtgaatgccaggtatctttctgatgactgtactgtgtattttctaatattctttgaaaactttgagatcagcagagatgctgagccctgctgatgaggaagggagatttgtttagagaccgctaatgatactttaaaggtgcgtgcagtgtgtctgtgtactaggcaggtgccatttaagtcagaagccactttcctgctttaggacaggtgctgggatgtggaagctagggatgcaaagttacagctctgtgttggtttattggccacctcatcatgagtgcttctacttcgttagtgacctctgatatgactgctggatagtcttcttgcagtaacttcctttaaaactacggtggtttgtggtgaataaaatttattttcaaattgtattattgcttttaactggtctcagagatctgggctgccttgatataggccagtgtttaactaagcaaagtgttatgtcagaatgtggttactattccattatttcttcatccttcaattttgctttaatttgatcttaaatttgcaagtacctaatgtttttaagagtgttatatatatcatttttccctaattttaaaacctaaatactttaacaagctgctcaacatgaagaagggaatggtttgaatcagtttatgaaagaatactctgttcccaggttgggtgggtgccctgtcaatagctttattatgtatggcaaacacaatgctaagaaaacttattagaaactgaagtcttaaatgcttgggagattataatgtgttccgacttcaaaattttaagttaacttccgctaccagtttctatgagactgatttctgtagtctgctttctgtagtcatagaaaatagtagtgaaagctatagaaagctgtagaaatggagaggtgggtgagaatttattaaggtgccttcaaacatataaactagaaatagattcagttatatcaaagataggcctagatgtggacggaatagtgaatagtttctggggctactctttcaacatggatctatctggttaattgatactagtcattctctactgctatttttatagcattcatcacattttaatttttgtggccatctcatcctgggctttgagcagccaagaataaggttagttcatctttgtatctcttgcatctagcatggtacctggcacatagaaagcattcaataaatactgtactgattgaatgaaacattttttacaaatgtgtttgaaccaaaggcagcctattgttaaccttggtgagccttggaaagctttttgcttgtggtgacgtagcaactgaaatattttgtaaaaagtgaaaataccttcaaatgatttatctctttctgatctttattaagacagcagtgttgtatccacacattcctaactgtgtgtagtcagttcttacaagttcttgccatgcttgtgtccttaaaatgtttcacaattttggcactgagaagccagagcgaagtgaaggagttgctcattgttctccatacactctgggttctcccacctctgcaccttggctcaggttttcccctttagctagaatgccctttttccttggctttggctgtctcctaatggattactcgctgtacctacccttctaggctgagctcatagctagcatatgtaatctaacatttgaatcagttgagaaaactcttattttcctgctctatacacccagtatagttggtttgcaggtgtctgtggagtttgttttatacagtgcctgttgggctagagctgcattatagctagtgtctgtaagaccgttctagtttaagagcatgcagggtggcgacagtgagatgagactggctgtatcagtttatggctgttcagtttatggcaggtgacttaaactgagccttcattttctcataagcaaaatgggaacttagtataactaagtaggaaaatgtatataatgcctaggaatggcttttgctaggtgcctaataagtagagtttccttttcttctctttatttcaaatgatgtaaaagaagccttgttttgaaaccaagagttgttaatctgaccaaatttcatgaaaggatattgatcacaacatatttgttatcagagtttggtaacacctgactaattttttgtattgctttgggatttatttaagcatgtgagactggtattacctaaggttttagttgacagaagatggatagcctgagaggtcgaaattatgagagcaaaagacttttgaaaatttctgccatggcatatttcatacgtttcagcttggtgtccagggtttccctgaacagacgagtttgtgacatacgagctcataaatatacttgcctgtgccctcttccagaagggaaagccagatctccagggatgctaactgttggggagacaatgagaggagcttcttgtctgaatatctttgttcacagcagagatcatatttgaagttcttctcttcatcaaaaagagcagaatggaaaatggtttaatattcctgtcgttagggtttccgctctgtgtggggtcatgagagtcacagtctttattctgaattctgaaatgatggtttgttttacttttaaaaatgcatctcacagggaaatagagaattgttcctgtgaacttcctgcctgctgtactaaacgcagttgctgtggcagtttttaaaaagaaattaaaatgcagtaatgctttaaatgtactgctttaagaaactcgataactcttgattagttagcataacaaacagcaaagcagaacttttttttttttctttttgagataggatctcctccagcccaggctggagtacagtagcacaatcacggctcactgcagccaggctcaatagatctgcccacctcagcctcctgaggaggctggaactacaagcaggcatcatcacacccagctaatttttgtattttttgtagagatggggtttcaccatgttgcccaggcaggtcttgaacttctgggttcaagtgatttgcccgcctcagcctcccaaagtgctgggattacaggagtgagccaccatgcctggcctagaatctttacataccggttttaaccatgttgtttcactttttgaagcacttaataggaggtaaatatacttttgaaagttacatacttaatagaaacacacattaatggtacccaaagaaccaactcactcgtagattgtgctccatttttgtgcggaagtttttgtgccagccaattacatttgcttctgtggtagatttctcttcattgggtcaaaggagaggcgtcattaaggaaagcgcatgtgtctttgtttcctctgggtgttctgatgtgagagagcctggcttcttcagtagaagattctgggaggtttttgataatcaagtgtgggaggtcttttctaattttcagtgcttcctggtgagaaaagcagatctcaagaagggctgagagagggtccacttgcctccacaaagatcctgatgctaatagaggctaaagagtcacttttggcttcaacttttaactgcattcttagggctcttaatgtattatggacttgaaatttgcaatgagagtagatctcaagtggtctcaccatacacacccacaccaagaaaggaaacgatgtgaggtgatagataatgctaattagcttgattgtggtaatcatttcacaatataaacttatataaaaaaatcacatacacctttattatatatataattcttgtcagtcatacctcaataaagctggggaaaaaatagaagtgtgtccataatattcaataaataatacagtcatgagccacataacatttccatcaaaaacggacaacaaactggtctcacaagattataatagagctgagaattcctatcatccagtgacattgtagctgccttaacatagggcaatgcattacccacgtgtttgtagtgatgttggtgtaaacaaacctactgtgctgcaaatggagaacacatacaattatgttcagtatataatacttgataatgatcataaacgactaagttactggcttaaaaaaataggagtgtggtgagggagagaccaacaaatagggcagagagagaggtagttttaatttctgggagagatgcggatattaaatttacctcccttggaaacactggaaggaggataaagcaagagggctctgggaatctagtggaaactttttaggtgtggacacttccgttaatcctttttttttttttttttttttgtagtttagggggcaatagtgtattaggctctaactttgggttttgtgatttccttttataagataaatttagttttcttttttggagtttaattgtttattgtaatgctaattgtcttcatgtagcatgttgtaagcttaaaatgttccgtaagagtaacctggcgtggtggtgcatgtctgtagtcctagctactagggaggctgagatgggatgatagtttgaacacaggagttcgagaccagcctgggcaacataataagaccctgtttcaaatcaaaaaaccaaaaaatatttcataaaaggtagctgctattaataatggcataattataataatatcttactgttattatatatccagaatggttatagcaaacttggtgctctttgaaaattaccacagcagctaaccctggaaaccaaagaaagccattgaggaaaccctagccatccccaaacttagaggaaataagttaaggcatttatttagtcttcaagggttttatttatggcaaagaaatgaggagaagtcatcatcagtttgatgattagcatctgttttatttagagaattttgacatcataaactaggaatttgtaaaactgtatgtgcatatttttctacatctggggagctaccatatgttatacagatctcatcccttacatttctagagttgtactgtaggaactatgtctagtaaaaatctcactcttggcttatatgcatttggaattaccctttcatataataaagaaatagggtattgatttctatttttgtgaatgcttactttgtgtatatttatctttttaagttttcgtagcagctctgcaaagtaggcattttatctttattttccaggtgaggaaactgattctgaggagtaaaataatttgctcaaagttttgtgatagtggcagtactcaggttggaaacaaggattggctgactccaaagtccattttctgtttgttacttaagttgtacttacacattttcctaaatttatttttctcatgacttgtcctcactccagagtctggattaccagcccctgtggtctagcagaagtttgggatgttgaggtagggcctgggcattggggtgtagacatcgatattgctggccaggataggggctaggccatggaatgactgtgggtagaactcagctggtggggagatatggtccatttgatggctgacattagtgagagggcaggagagtactcttgatcagtgattggtttcccaggacagaagcaaagccttccctcaggcttcctgagtgaaagagcatccttcaaacatcgtgcttgaaaggtggactcttctcctcggttcagtggaggcagcctgcctgggtcccttgagtgcgccttcatcctggggcatcttgggatttaggaagcttgtatctgaattttggaatgcaagggcttctggtgggggccattatattttcagctaagattggccttccctggtccagagcctgcacacgtttctaaaatctttttcaaactctctgctgcttcattaaagtaagaaaaaatagctacactctagatttggtttcttgtttcttcaatgacactttgtctcctcatcctaacacagtaatcaactaacctagtaaactaacccatgttagtgtagctaatatccataaatgtattagaggaagaattcttttttagcaagaaactccgaggccatgctccctatctttgtctaactccttggtgactttagtaatgagaattttaatctagaggctccagggagacaccctccccacaaagtgtgggattgctcctgtattctgttaatgcctatttgttaaaagagttaacagtgacccttgaaccatgaagcaactctttttggtgctaaaagaacacaagtgcccaagaatgcagcagcatcgaaactggggatgaagtgatttgttcttgacatcagttggcaggtacattctcttgcagagagtaaagatgaaatagaatcccattcatagaaggcagtttgtagggagggaggctggggatgggaaaatgagctcaggctcagaggccttttacgtcttagtgttctcacaaatatgcttccaataaaaaccatttaaaaggcaaaatataaaattcttccatttaggaggaccttgctgagatctatggtggtggtttaaactgtgccgtgattagaaccatgccctatgaatgtgtaatatgttgtcgaccagatggtcatataatgctcactgtcctggtgagtttgaattagggagctggggaaatcttggctgagaaaaggtaagataaggcaaaagtatatctgcttgaggggcaaagttgcattcaactgatttggtctctgcagaagtttgccatagaaatctgtcagtgtgtactgctttctactattaattggggttttagtcacatgctttgtggtttgttcatgaagtttttatttaaatgacttatgagaactatcaaaatgtttgctctgaaggcttaaattgtgttcttatgccatggattttttttcagatgatcaacttacccatgtgaaaatgcttgagcaggttggctgccaaattgtaatgaaaggctgtcagcaatgccttgatttatctttctttcacctctcctggatatgctgtctgcttcctaagtctaagagggatatactcagtcctgcagacaacatctgtgcttctgcatcaggttccctgcctttcttgggagctttaaacataagagtatcaggaaaggttccatagttggtgacaatagaagataggttagttttgggcaaatgaggaaatgaaatgagcttctctttctcctagcataccctgctgagatttattcccagcaccttcaagggggctattgtagaatgcaatccccagtgctctcagtgaaagggagaattacaaagtacagagtcttatcctttcactgtaatcccgggtgcacacttggattcttgatctgtaagtgggagtgtggtccagacctcattcaatgtaaagctcttatagagaccctgattttttaaagggaatttctgctgttgccacttgtcttgtcatcttctccctgagaatgttttaccatagcagttaataagttatgtgattttaaatacctcttcacttggaggagtcagtgcctgtggtaagtcctttgaccattcattaactcattcaaactctaggctttagctgacaactttttcattagcagctttctttgcttgttattttactttgattttcatgcttttcaccttatatgtgtctatctgttttccctctaggactttcatgaccctacattttcagcaattcattgtctgtctgatttgatgttattaccttgaggcctggagatttcttacacagaggtgtttttcattgacctggataaactcagaaacaagtcatcactgtcttttggcatcccgcctccccatttatgtgttattcaccatagtctaattaaatatgttaagtagcaatgccggaagaagtagattctgctttcaaaatggttttaatttatctcaacaaaggtagagaaaacctttgttgctttaggagtctaggagactcccctgggcaaagtttgctgttttttcttcccagattccccttgcccttcaccattcctccaagacgcttgaggaatgatgatttaaaagaaaaaggtcatgagggaggactggttcatagatatttcatgaaaaagtgtggcctgtcttgggattaaaccattcctgggaagtagaaatgagctcttcattgctttgtaggcaaccacagtatataaatactgtagaagatctgggttaaaaaccaaagcccaactgttatctatagtgtgctgttgccaagctcccagtaaagttttagtttaacagaccacattgtggctgataatgataattttgtgttatccctattggatgagtggctagcctgtttccacagtagacagatgcttttcttaatggcagacaccagcccagggccttgctttgtagtaggcctttgataaatgtttgttagatttaattgcctgctgacttgttgagtacggagtgtgattagattaaaactaatatgttgtaattaagaactatcagtcacaaaacaaatttaatttttttctataaatgtatgaaatataaaagttataaaataattatgacttatcaaggggaaagttgtgacttatcaagccctgcttatactgcattcagtagctgaggttcagttcatttccacatttgagtttgaactccatgtctggttgttttttaaatgtgtgtgttttttctttttttttggtgggaattggagttggggtctctctgtcatacgggctagagtgcagtagtgcaatgatagctgactgcagcctcaaacttttggactcaagccatcctcctgcctcagcctcctgagtagctaggtgtcatcacacctggctaattaaaaaaaaaattttttttttttttgtagaggtggtgtctcactatgttgcccaggctggtcttgatctcctgggctcacacaatcctcttgactcaacctaccgaagcactgggattacaggtgtgggccactgcgcttggctgcacgttttctttccacagttttttctgtcctttgttgaaaggcttcattgtcctgctgataattaggctaatataataagaattaggaagattcttctttatcacctgttcttagatgacaaagattcttagaaattcttgctctgtttattttgtacttccgggtaatgtagtttagatctgaagagacataattgaggttagctctcacagaggaggaaaatacttgtgtactaaggatcagtttaaatgactcaagaaaagcaatcaaagaagtgttatctttaccattgtattggtctgttctcacattgctaataaagacatacgttagactgggtatttataaaggaagaggtttaattgactcacagttcagcatggctggggaggcctcaggaaatttacaatcatggtggaaggggaagcaaacgcgtccttcttcacgtgtcggcagcaaggagaagtatgaacggaatgggagaaaagcccttacgaaaccatcagatctcatgagaactcactatcttgagaacagcatgagcctaactacccccgtgattcaattaccttccaccgagtccctcccatgacatgtggggattatgggaactacaattcaagatgacatttgggtggggacacagccaaaccatatcaaccatattctgcctaaattagaagcctatctctaatcacagcttaattattcaagtgcctaatgtcaccacagattcttcttttaattggtgattttctaatactattgcaggaccttctgattgatagtttgtgcacaagttttcaaaaagaagttagtgtctctttttaagagaaattcatcaactaaagtgacattagaaccagtgattaaaaattactgaggtcacatctgtggatgtctatgactgtctactttttgtttatagaactcatgactgtttaaatgaaagcagtcacctcagtcctcactaaaaacaatgattgttaaaaatataaaatttaaggtggctagcaggatgaggcaataaataccagataaatggagtcatgagtaaaagtattaatgtcaaggcttctttttggttgaaatctaaatgctgtttttcaatttggacttaacagggagggtgctgcaaatgaaaggagcattttttttttctataaagcctaacacagtgttagggtgtcttagtccatttgggctgctgtacagtaacagagtactataaattaggtagcttctaaagaacagaaacttatttctcatggttctggagactgagaagtccaagatcaaggcatcagcaaatttgaggggaggacctgcctcctggtttggagacagccatccttctgctgtatcttcatatagcagaaaggataagtaagctctctgggacctcttttttaggggcactaatcgcatttacgaggactccgccttcatgatctaatcacctcccaagagccccatctcctaaaaccattacatttaggggttaggtttcaacctatgaattttgaggagacacattcagtttatggcagtgggagatactttgtcttcagataattagatctttaactccgaattcttatgtaccttttagaaataaggactgatttagactagagttgttgggcccggcgtgacccgaagtagtggagagagcacaggactagagcgcagacctcaggacgtggatccgagccggcgcgatgggcggagagcaggaggaggagcggttcgatggcatgttgctggccatggctcagcagcacgagggcggcgtgcaggagcttgtgaacactttcttcagcttccttcgacgcaaaacagactttttcactgcaggagaagaggggatggcaaagaagcttatcatacagactttcagccacgacaatcagctggcacagaaggcccggtgggagaagagaacccgggagaaggtggagcgggtggccgggctggccaaggaagccaagtcagagacctcggggccccagataaaggcagacaggcagagaggctgcagctagagattgaccagaaaaaggatgcagagaatcatgaggcccagctcaagaacggcagccttgactccccaggaaagcaggagaagaaggaggaagatgaggaggacaaaggaaaactgaagcccaacctaggcaacggggcagacctgcccaattactgctggacccagagcctgtcggagctggacctggtggtccctttccgtgtaaacttccggctgaaagggaaggacatggtggtggacatccaggggcagcacctccgggtggggctcaaggggcagccagcaatcatcgatggggagctctacaacgaagtgaaggtaggggagagctcgtggctcattgaggatggcaaggtggtgactgtgcatcttgagaagatcaataagatggagtggtggagctgcttggtgtccagtgaccctaagatcaataccaagatgattaaccctgagaattccaagctgtcagacctggacaatgagactcgcagcatggtggaaaagatgatgtatgaccagagacagaagtccatggggctgccaatctcagacgaacagaagaaacaggagattctgaagaagttcatggatcagcatctggagatggatttttccaaggccaaattcaactagcccgtgctttttcctccctgaactcttggggctgagctacaaccatccaaccttctttcccactcttctctggcccttgtgagcctcagggcttggggtaggcatgggactggcctagacacacggatcccagggcatcaggagaaaggctggggcttggggtcttgtcttccccagttggcctactgttaggcattaaagcaatttgcccagcaaaaacagaaataagtactgatttatttcctcatttgtgatgccaaattgtaaagattaaggtaattgttctgttaaggtatgaaaataaatgacttataagagacagaggcagataggatattggcaaccttcacaccctagtttgaaaggtactggcctttcttggctgtgctgaggcatgaataaatactatagcaatagtaaccacacctttgttgtattttatttcttcaattaccatctgttgttgcagcttttagctaaagcagagcttcccgaacttccaacttgaatcatagcactgcgtcttggtgaattgattctagaggtggaagttagtgccttaaatttgatgcagtcacatatgccttttgggtgacttcactttgaatcctcaaaggatgacttagagaatgccaaataaacaccctggcaactggtaatgaccttctgggagattctgacagattaaggtttcacaacaaacacagataaaagacaatttttcagaagacaatggtgaaggaactgagtaagtaaagcataactgaaggcagtagaggtagttgagtggaaatgcatagagagctgggaggagtggagttcaccagcaaatgtgtcttgtgtatctggctgggaggtgtaattgggatggagaaaggaagggcagcatgcaggaagtcatgtgataggaatagagctgtgtgccaggggtggcaagttgactctgttggttggtaccaagagtttgccttactgtagttagacagagttagtttttgttctgaatgagacaccgactttcccatatttcccgataggggttttgaatatagtgacttgaagcaagaacattattggaactatggtatcagatttcctgaaggtcacattattcattaataataatgttgctctttgagcccttaaaattggcctttttctagactcctaaactctatatgttcttaatgaaataacgctggctagagcccttaccaaaccctgaccagaaacagtgaattaaaagatacagaagactgggagctagaagttgttttttttttttttttttcaaacccatattgtctcgaaaacatctaccttaggatctattcacatccttattcacatgccaactccttgattcatttgcaagattgccaccctccttgctatttacaataattcattctttaatttcaaatttttatgctattttcatattgtttaaatgaggttctctacctacccaacatggtagctatttgcctaatatcttagttgtacctaaacattgtggaaggtagtttcttttataaatttaaaatgtttggcttttcaaacccctgttttctcatcttcctttgtcagagttctgtttgaggtgaccaaagccacttggatcctgatttagtggatgatttcagtgaaattaagactttgggattgacttttctctcccccccactcatcacagtgggaatgcatttttcatcttttctgtggggtgatttggagaatgactgagatggttattccttttttcctcctgtttcagtctgttctgtgctgtaatgacagaatacttgagactgggtaatttataaggaatagaattttatttctcaccgttctggaggtgactgggaagtccacgatcaaggtgccagcatttggtttagggagcatttggtgaggaccctcttgctgcatcctcatctggcagaaggcataagtgcaagtcatccaaatgcggagtgaagcctcttttataagagccttaatcccatcgagagggagaagccatcatggcttaatcacctttaaaggctccacttgtaaataccatcactttggcaacacctaaattttggaagggacacattcaaaccataacaccccctgtcacctattgtctgccctccttttgggagtgggcagtggtgctgactgacagatggatcctccaggcttccttgccctctggcttctaactggattggccaagggggaacttaaggagagctaagagtgggaggggagagagctgccagtcgccatatctcttctctctgcctgcttctctgctgcagttttgtcagtgactgtgtcccaccaagaaaccactcttgcctggtgggtcctctttcaggcctccagcaggttactttcctctccttgatgcttcgagtcactttctacctgaatgccccttgtggtacccttcacccttccctcatctttgtaaatagtccttcagtcagatgtcttcattgaaactatgtgagttgcctctatgtagtacatgtaagacactgttaattaaaagtacaggtaagacactgtggtatcaacactttaatatgaggaaacacatagcacattaaatgtacatgattataagatatgtcttaatttcagatacattaatacttagaaacaacacccatgactcttaaaacagagggaaacctatgaaattgctactggtttttcattgtgttaaagataccataataaatgtctttatttataaacttgcctatatttgagattatgtccataggatagatgagaagagagttatggacattttctaagacttgtttctttttgccgcattgcattctaaaagggtaaaacatatttagagtgccacctgcagcttcttagctcttgtttgactgtccccctgacagcaatgtgtgttgacttttccacaaatctttcctaatctgataggccaaagagagtctttccatttggaagtgaaagtgaacattttctattttattaacaggttgtatttttcttttactttaaaaaaatctcttttgcctatttatttattgggtcttactgtttttcatatgcatgagctctttgtgtagtaggtcagaggttagctaactttttctataaaggaccagataatagacacttcaggctttgtgggccatacagcttctgtagggtgaaagcagccttagacaataggcaactaatgaggatggctgtgctcccatatggacgctgagatgtgagtattatatagttttttatatgccctggagtatcattcctctttatttttttagccatttaaaaatgtaaaaaccattcttagctcacgggctgtagaagaacaggcggtgggctggatttgattagcgggccatagtttgctgacccttgtaatagatgataactcatttaatttattttgactattttcctcacttccttttttagataaattttttaggcctacagaagtttgaatttcttacaacatcaaattttaaatttctgaccatttttgtcatgattctgaaagttagaatgttcttactaacgatcatatccaaaaatacacgacttaattttagcttcggagacaatgttttttaaagaattcgcttttattcatgtggaatctagttgtgtatagtgtgatttggaggtctaaatttaatttttttgcaagcagcaaaccaattgtgggttgcttttgaatcctcctggttagtactgggttcactaactgtgctttgggtacctttgattctagatttacagcatgataattttcccacttttcatttatgttcaagaagtatggtaccaaactgtgacatgagttcctcttagttcttcttggctcatctgtttccatatgagctggcattcacaggaaattcagaactcttacaggcataatattaatagatacatgtggaaagagttgttctctgaaaaaaaaattttgactttttttttttttaatgaagaatgacaacttgatctcccacactaggaaagaaaagtgcaattaatagtttatattacataacattaactgttgggttttttttttttttggcctttggaagatacactcaaatttgtgataagtaaaatgacttatttatcacaggttaccatataagattggacaagaacgatcttttatttctagtcttttaggttgttggagtgacctaaaatgtaatttgaggataagcaaaaccctgatctgctgaaaattacaaaaccaaatttgcaggcatggctttcttgctcctgagactgaaaaatttgtctgcttccaattcagttgactataaagaatagatagcatgcttttattttctgacagcactaagagttattcctgctgaaccaggaatgctgttagagtgtcaaggatggatttgccttaacttatttttccacaaagctgtaatttaaaaaaaatctgttaacatttctttgtaattctttggttcacagtagacagtcccactgcagaagtcctgctccggtcagcccgtatttccagagtgttctttcagaactggaaatgtctgtatattcagctgggttgccatggtgctgtgggacatgaggtggcaaaccctacacaagagttaaagagatgagtagtgcttaggatacagattacagaaagtacagcttgccatcaagttctaggcaagagatagaactaaatgtcttaatcctaagaggaaaaacttcattccaagggacattgggtttagatgagattcattgttagattatgccccagatggcctgttagctttcttaggaaacttgttcccattttgtgtctccacaatggttctcagctactatctggaccagtcccttaaaattaaaagttaaattagatgtgatgtgatttgaaatttgaaacctatgtttttatttaactagactacaatggtacacttagaatttttgttcaacttccccacccaatatgaatttggagaaaaacaagaatgactaaaaaatcagcaggctcacatgaaattgagaggacggtttggaaatctccttgaatttctttttgtaagccaaatttatttttataagcctttaacggaagacagtttgttctttggataattggcccaggctttatcctcctctttcaaatatgcttcaaccaaatacccaactgtgagatgaataggataaatgaaggtgggagtcgtagagtggtgggggtgggtgggccagggggcggggcggcggcaggcaaaacagtcatgtggaatcttttgtttcatttttaaaataattcttaagagctgctgtctttcgacagagtcagaaagtccttgcttaagtgtatttgtcactatagagagtgaatgggattctgaagtctttaacgtggttctgtaaatgtaagtcttgttgtttaatcacggcatttctgcaaaaatgaactcctgtacccacatccctccccctctcctttattttagtgtcttagaactcagctaagcatttgaacagtcattgctaagtgtttccacactgggggagctagaagaacttggctggatagaattctgattttcatgggagggaattagttttccgttttctgccttagaagtcatatactatacttgctatttgggctgaactgacttgaaaagtcaaacaggaatgagtctagctactaaatttagagaactgattcgtaatttcttgatctaatacagtgggcagtcttgtcattgaccagttatttatttcagtgtttgccaaacctagaatgaaatccaaggctgctgcttaaccctctatagctctggtagttcatttctacttctcctgctcatttccgaagataacatgtatccagagagcctgtgaggtcctggcttagatgagtcctgcatatcagggcaaacttccatgcctctggacatctttcacatttcagacattgtcttatttctttttcttatccagttaacaagtatgtttttatttaagtcaggctttaactctcccctctctcccctctcccctcctcaagggaaatttaaattaagtgggaaattactttttgtatagatgttcttttgtcttaaattcatgctcatgtgactttccacttgccatttagagtaacagttattcaaagagcattacctaaattccatcattaagaaaaaaacttatgcccctgctctgctccttcacccctcatcattatttttaaagctctctaaatgcctgtcttgcttaaagaatcataagactatggaagtggaatgcacttggcatgttgttcactattccatgaatttgtagactaaatatgttatttctgtggctcatccagaagatgttgtcatcctttaaaattgcaattagcattattgtaaaattcgttgatggaaaaagatctattaaggttacgtgtattttggatttaatgttgctttacctaaggatgttagggttcaccaaatcctgctttgcttgggatatgcagggaggaaaattgagaagaaatctttttttttcccattaataaatgaaagaacttcaatgtgaagaatttaaaaaagtcccaagcacagatggttcacctgggtaatttgcaaggaaactggatgagcataatgtaggtggggaagacttagggaaattattcggatagttcagttcctttccttttatctgtctgagccagttagggggaaaaaaaaaaatgaggtttttggatgtcagaattacctgctggaatttttcatgcacttttcagaataaaaaacgtcaaaagagagaagttaaattttccagtatgttttaagaaaataaacaaaatgagacatgctggggaaagtgataggacactttcaggttgtgaacctcagggagtttcctggctaagacaggtggcttggagttttccctctttctccttctctcctcccttctactttacttttctccctctcttcctcctttttttttcttttatttgcacacccagaagcatggacctttccttcttttggtccttctatccatcagggtcaggtctttcaagataagtggacacaataccactgaatctgtaaacttctgatttgtatgtcattcttctctgtgagccagcgttgtcactggtttaaaaaaaataaaagctttggctgggtgcagtggctcacacctgtaatcccagcaccttgggagaccaaggcaggcggatcacctgaggtcaggagttcaagaccagcctggccaacatggcaaaacctcatctctactaaaaaatacaaaaactatctgggtgtggtggcaggtgcctgtaatcccagccttgggaggctgaggcgggagaattgcttgaacctgggaggtggaggttttgcagtgagccgagattgagccgctgcactccagcctgggcaacagagtgagactccatctcgaaaaaaaataaataaaataaaagcctcagcatgttgtcctctggcctgcgaacttgctgaagtattattccttgttgtatcccccaggctatgttgctgtctagcctgtgaataaggcaaattccatattatggaggtagtgggctgtgtgaaaagagcacagattttttatatgatgagttacacgacttaaggctaagtacctaatttgtaagtcctcatctgtaaaataagaataatatctagttcaaagagatgcgagaattataaattctcctatgtaagatgctttatatattgcttggtatacttggtaggtcctcaagaaatgtttgtttcttttctgctaggtctctagtaattggaattttggatgactgaacattcaaactgatgatttttggatgattaacattcaactgattttttgagcaattaatatgtaaggcttttctaagtcctgagggaggtaaaacatgaatgataggtagcatttgcatgcacaggcactgttttaagccatgtgtacattttatctggctttatcttctatacacagttatgagatatgcaccattatctccagtttattgataaagaaatagtatagaggattgatttatctgagaccacacagctagtaagtggtacagttcgctgaggcataaagagagaaactgatacatgtaatacaaggcataacatggtacttatttttaaaaagggtgaacatgaccagatgattgagaagagaaggcaattgtatttggtttgggtaggaaaattaggacaggcttcagggagaggatgtcatttgagctgggcatagaaggaattgagtgtgttgtggagagacaaacatgggagccaaagagagaagaatgtggtggccacggagacaggaacacttgggtgctgccccagagcagcagacagcttcactggctttctgaagaatactggatgtgtgataaacaatcccagaagctgcccctggaccctgagctggtgctgggatcccagacctgaggtcgggtttgagagtgaggcttcctctgcccagggttgccacgtggcagtggtggaggctgaacattgatagagaagtgaaatcagaaggtaggtgactaatccaaataaaagttgtggatctgagggtggaggagtagaaggtggcagcacaggatgagggaggatgtttgaaatgatggttgaaagggggaagcctagagaagtttgtgagccccggatggtctctgctgtgcctttttaatagatgctggtccctctggacgtgggtgaggagcagcttattaagtattttcttcatagtattgaaaggaagtaggagacaaaagcctgggtggggaacctgagatggggtgttggacccatggaacctacctgccagtgtcaaggtagaggtggaaggatttgataggctgttgaccagttttttttctggggttggcagtgaagtagtgacataatggggattatgcttgaggaagattgatctgccatttgtatggggatggattaggttatttagactttagggagggaacttgtattggtgcctttacaccttggggcagaatttgtaaggctttgcaatcgattcgattgagaggctgggaagtgaggaagcagttaaagatgaccttaatgtctttaatagtgtttctatatgtattagatatttgggtgagttctatgtggcaggtggagtgctagctactggatgaagagtgctgagcaaaactgtgtgagtagataggtggggaggaagtggaatgaaagtggctcttggggtttgaacctgggtcctggggaaagtggtgtgacatttactgaaacaggacaggcagcagaggagtcggcttagaagccctgatgatgcattttgttttgatgagttgagtttgaggttgatcacagcaagtgatcaatcataaaattagacatcttggatagagattggagatggcaacagatagaaagtgggttgaaaaacaaagaatgggccgggcgcagtggctcatgcctgtggtcccagcactttgggaagccgaggcgggcggatcacttgaggtcggggtttaagactagcctggccaacatggcgaaactccgtctctaataaaaaatacaaaaagcagctggatgtggtggcacatgcctgcagtcccagctactctgtgggctgaggcagaagaatcgcttgaatccaggaggtggaggaggttgcagtgagctgagatcgcgccactgcactccaggcctgggtgacagagccagactcggtctcaaaaaaacaaaaaaaataaaaaaaataaagaatgctcttttagagattcaagggaagcaggcagagggtatggccttatgagcaaaacttaaattttagggggcagaaggaagatgctgcaaagagtatggaggaggaatcagtataacttgtatatttctacctacctgttttcttgtgcagtttgtttcctttatggctttagaacaaggtttcttaaccttaacactatttatgcatttgggaccagataactgttatgtcataggtgtgtcctgtgctttgtaggatgctgagtggcacccctggtccctgcccactataggccactgagtagcactgcctcttcccaattatgtcaaccaaaaatgtctgtagactgctgaatatgccctggggggcagtcacccatagttgagccccactgctttaggggtaatgattttgtagttttctttcttttttcttcccacgtgtatcctgcccaaaccacagccagggaggaattggaggcaggcgatgccagcaaaagggttgaaccttcatttggctgcaaggagtatgtgactcagttctcaataaagttacatgtaggaagatgttgggaattatcctgtgaaacagtttcatgtactaggagaagtgtgaactgctaagactatttcattgtagctctcaacaggcctgggcctgtgatatgactgcatttatggacactggggtgggatggagtggagggaattttagctctgaaagtttggggaatttatcagtttcaaaaagtattattttacagaagtccctatgtagttcttcaatgcctttaggagaagctattaatttaaatgtgtcctgtcaaagaaaataaatgtgtgtcctaataaaggtccctaaaagttcacgttggacatctcacccctccaaatgaagtgacacaggaggcatacacagtcctagtggtttctgcatacctggcacactgccttttcacctggtagatgcccatgagttagttgagttgaattgaaatcccacctgtcatttatgcttgaagaattcttcctttttgatcttgaaaggggaaggagaagtgcttggaggcaaaaagctttaatctgtgcaaaatatcaaagaataagttcatgaccatgtcagcggcattcacagtttcatttgaaatctttatttagagattggccttggatttgggtgtgcttgttaggtcagtggaggggaggctgttgattcaggttggggcttttttccatttcttagagttctccaggtgctcctctcctgcctttgagcctaaagttcatttctgacaggtgcttgatgaagtggttattataatcagtttggcctaatacgctattcataaaacttgaaaattgaccaaaaagagagaggcagagaaaaaaactgaactatttttaggtagtttcagatgttgtgtttaatctttttttttttttttttttttttttgagacggagtctctttctgtcacccaggctggaatgcagtggcgcgatctcagctcactgcaacctccgcctcccgggctcacatgccattctcctgcctcagcctcctgagtagctgggactacaggcacatgccacccagctaattttttgtatttttagtagagacagggtttcaccatgttagccaggatggtctcgatctcctgacctcatgatccgcccgccttggcctcccaaagtgctgagattacaggcgtgagccactacgcccggccgtgtttgatcttttaaaagcccataaatgctaagcgttgttctcatctgtaaatagtggtgaaacatgaaggtatgaacaggtgtgctctaagtcagagggcggagtggaggggaacctgcatgaagtatctttccttagcaggccaggcacattccctgctgtttttggggagcgggctccaggatcctttccctcttggaaaagagcagaaagtgccaattggatctctggtcactgaataaaactgatctaccctctgagtgtggcccagctcttaacaggagcaaattgagacctcaactgaattctgccttgaagatcttttgtgatgtttactggtccacgaagacaggagagtgagggtaggaaggtgcaaggacagatagttgctgccaaaatgaatttggccaggttcattcatctgctctcccttgcacacagctctctcattccttcctctttgactttttaaaaaataaactttttgttgtagtatagtttcagatgtatgggaaaaatgaggctataatacagagaattcccacatatcctgtatctagtttcccccattattatcttaagttagaatggtatgtttatcacacttaatgagccaatacagttaccttataattagctaaagtctgtgctttattcacctttcctcagttgatacttaatgttctttttcggtccggggatcccatccaggatgcggtgtcacatttagttgtcgtggagccccaggctatttttggttgtgacagtgtcccagactttccttgtttttgatgatcttgacagtttcgaggagtactggtcaggtgttttgtagaatacccctcaattgagatttgtctgttgtttttctgtggcgattcaactggggttgtggattttgagggggaggatgacagaggtaaagtgccattttcatcacatatcagtgtgacttatcacatgctgatccttatcacttggcggaggtagcgtttgccaagtttctgtactgtaaactgaaaaaaaaaaaaaacccacaaaactgtaaaaacaacaagcaaaaacccaaacagctctgtcatcttcagaaggacgtcactgtgtacagcgtacacttgaggagtgggatgttgagagaggaggatctatctaacttatttggaattcttctgcctgggagatttgtctcttcttccccatttatgtattcagtcatttgtatcagtgtggactcatggatgtttttatcctttgggttagaatctaatactgctttattttgtttgaatcgtttcagctttgaccattgggagctccttacttggcttctgtgtccctttcttggcatacactcattttttttttttaagtacttcctttctggcactacagaattcctctttgactttttgtgtgcctttgtaatgctttctgcctggtgtaggagtagtgacagatcacatacttggtggcctgaaagctaaggttttggtctcagctctgctgcccaattcacgtcacctttgtgaccctgttgtctctaaaatgatctttagctaacagaattataagaaataaatgtagggccgggcacagtggctcacgcctgtaatcccagcactttgggatgccaaggtgggtagatcatgaggccaagagattgagaccaacctggccaacatggtgaaaccccctctctactaaaaatgcaaaaattagttggacatggtggtgagcccctgtagtcccagcttcttgggaggctgaggcaggagaattgcttgaacccaggaggcagaggttgcagtgagccgagatcacgccactgcactgcagcctggtgacagagcgagactccgtctcaataaataaataaataaatgtaaaaggacttcacacattggttatcaatccataccccccgccttttttttggacattgaagcacatcttcagacttccatctctgggtctttctgcagccccagaacatgtttattgaatgaattaatgcatcttcaatgaatgtaactgttactactgtgtatcatcggtttgttcagttaaatacgtatcaatggacaagcttttcctttcctacataaacattttgttttttggttatcttgtatctcctcacatcccatagcattgcagtggttcacaggcacttaacagagaaaggggacaccaagctgaatttaaatagaaaaaataatgaaatatatatcatctttggggataatgtcattttctgtttcttcctacaacttgagccctcagaattactcgtaatggggtgtttgtgtcatctgattgccaatgatggctgagtgagtgaatgcatatttggagtgacctggaattctgatgtaggtaagggattcagaaggattatgtttagattaatttttctgcagagttctccagcagagtcctaatcaaaaattggtggtggtggcggtggcagtggcagcagcattaaacacaacaaaggcagaacggatccttatttgcatcattcagtccagtgggtgccgttagctaccatcctagagtgggtgtggaataaattatatgtataaaatttttttgagaagaggaggatgagctggtcacatgtggcattttctcccatgttgaaataacatgagatggagaacattgtgtgttgatgtctatctacaagttgatttttgtcttaagataagcagagcctccctacaacaggccctgagtactgcatcaccttcctccagtttgaaaaactgacgggggttcttaccagtctttgttaattcctgtctccggaaagaatggttggtaaaggcacatccgtattctgacatgttgagaaagaaaggatacatgcttgggaacagaagttgaggctgtaaattgttggtggtcttactagtattgggaggctgttttatccctggcatctagctgcttgtatggacgctggggttctagaaataagtttttactcctttggctataatgagctgggcattatcattaactagaaggctggattggaaaggtttgggaagcaaaggtccttctgacattcaacgcatcttcctttctggtcttttttggagcagatttttcttctgtgctctctaggaagctgatgtggttcctgtcctccaactgaccagtacctagaatgtcaacagaatgactcatgtccccaacatcctgtccttgttctggagaaagggaactgtttgcctttggaaaacacagtgcttacctctggaaaaaccccaaagcaagcatagcttcaacacagttttccttaaagctcttgtgatgtcttgtgattttttttccttgtgactttttgtaatgaaagtgttggttttcctgtgtctaccttgcgtgccaggtggttgagaattagggagctttaggtgttggaaaggaccctagagaccaactggtccaactcctctttatggttttagaaacaaaggccaagttgaagtaaagtgacttgagatctagaaactggtcagtgataatcaggactaattagtacctgggtctcctgattcctggttctgggtctttgatttttatggtttgcagtaggtttttgaacagttcacttggctgccttattggaagttctatctatgcagaatgatattgatatgggtggatatttaaaactacatatattataacatagtaaagtctttaagaatacatgatatacattgagttgttattcagaagctagggggatgtagaagagtaagaattcttctgattttcaggacattctgtcataatttagccttaagacagattttgggcaaggtatatatatctcttgtgactacaaaaggaggctggattagattagtttcatttgttgtttcaggctctgaaatgttatgattccctatgtctataagtgtatgctgcacatttttttccttcagtagtagagaatgtctgcaatgtggttaaatccttattctttaattccagtattatagaatatgggttccatgtaatttacattcatgttgtttttcttgtcaaagagggaactgagatagttatctactgtgttcagtagcattttgagtggggagagagagctatagtgtaagcttgaacttgagcagacattagcactctgttaggttacaattggtgttaacagtagagaaaagaatcagaggaagaggaggaaagagactggtgtgtgggagctaaggcccattattttgttatgggcttcttccccttttgagtgacttaaatgatgtgattgaagatatttgatagctccatcaagatggtagtctcaattccttctacagcccacactttctcctcctagatttgaattgttatgatggtagcataatttttgacaaatgatgtttgtgtggaagtgtaccttttatctgagttgagtcattgcttttgatattatcacctccattttacagatgagcaaatttagtctgagagaatggttaaatttagaatttaaccatatgaccttccaggcaccacgtactgttccactttaagtctaagacgtttcatttacattttgttcttactgatttagaaaagtttattgttttcattttctcacattacttcctggtgcctggcataggactataactgaaacatttttataaatgatttaaaggtattgaatgtgatgaactggaaaagaagaaaaaagcttcctgagtcacccagacttcatcctggctctgtcactttgtaatcttgagaggaaagattaacttctctaagcatcagttttcccacctgaaaaagtcaggaaaatattattttccatactgggttgctgggacgattagaaaccgagcatctgaaaactctttgcacagtgcttaaggtaattaatgagtgtttgtcattatacttatgttgatgttaaattaacatcttaaagaactctaaaatatttttcactttctgtttttgttttttttttctttccccctgaagcttcagaatgtcatttcctctaaatgcctgccaccctcagggagttctagtaatagggtgaacataacatcaatggaatatgaggagttactattagcagatgctatttgtttcccttttcatttctttttttacagtcgtttgggagaaacccttccagccctgggcgatgcggtgtgtcagtgtctgcctttctgccgactcctgacagcgcctcccttcaggggtgtgggtggagctcttcatgcctgcccctcctgctcacatttctcggttcactggaaaagtccccaaatctttttgtctgctcagttgtggcctagtagccagagtggctcgtgcattaaacgaagaggaacctatgtttcttctcttttcagcattttggctgaattttgaatttttatctgccccattgagtctgttggctctggctgctgctgtaccaagccctctttctggtgttcataaaccaatgagagtacaatttcatggcctgggtcaggcttgtttgttggtttcgtcttaattagaagcaaacctctttgtcttcccttttcttcatcttccagggagaaatggattttctaggctgagcaaattaatcatagtggtgtctaataaaaaacaatcaccactgcagtacctggcacacagtaggtactcagtagctgaaagaaacagttcctgtagctcttccaaggtatccagcattttgtgcaggtaggctgggggctgctgaaggatctgtttgtgaaagacgagaattagcttaagtaacttgggttggaaaagtcactctgccttctgagtgacatatgggggctggaaggtggcagagaacagggttggagagtttctctggtaggtggattagtgttgttcccagctcagaataaggtacatatttgaaagttacttaacacagagccttggattctgcctgtaggataatagatattgagtagttgtgataagtaatcatatgtagcacttaggtctttttatcttcaaagaacttttttaaaaaaaacacttttaaacacaatgaattctaccttgtatctttatcgtagccctaatgttctcttctgtgtctttgtcgtattatgtttcttaggacaagtgagtaagctttgtcaattggtttataaaacatttatgcatttaaagcttccagggagtgagaattgaaattacagtatctggggcttcatatttgctggcaaactgctggcttagcattttcttccctcttgtctgtttttcccaagctatagcagagattaaatgaaatttaggaattgtgtgtgagattttgtttctccttgaaatacagatgctcctagacttacgggtttttttttgccctgataaacccattgtaagttgaaaatattgacaatattgtaagtcaaaaatgcatttaatatagctaccctatgaaacatcctagcctagactaccttaaacatgctgagaacactgacattagcctatagttggcaaaaccatctaacacaaagcctattataataaagtgttgaatatctcatgtaatttattgaatactgtactgaaattgaaaaaacagaatggtcgtatgggtactggaattatggtttctactgaatatatatcgcttttgcaccattgtaaaattggaaaattgtaagtcagggaccatctgtagttctgtcaggatgggtgaaatgcttgctgtgcagtgcattgatttctaaagtcaatccttagcagatactttaaaacaacaaagaactagaagtttcctggttaagagggaagaagggtttgcaattggcttcataaatttcttctcaggcttttaaagttatgagtcaagaaccttcgaagcagtgttcgtaggtgcatcctttccttcctcaccccatatttcatttatataacaagatacttcaaagatgctccaaagaaataaagacagtataattccaaatgattagctcaaatccgactgccacattcaaggcttaaaaaaaattctcaattgctgtgagggattagaaaaatggcagctggcaaaaatgccttcagtataaagatgataagacgccacttattaattctttatataagcaatggttttttttggtgaggatatggagaaaggtaataaaatcatggtctctgctgtgggtaaaactagtttgagagcccctcccctgctgcttttttcagaagtttaaaaaggaggtcaggagcagagagttagtttccctgactgggggaagttaaggaaaggagtgtgagtgaggtcatggagaaggcatggtgaagtttcacagtcttgtggataagtttcccatttgatatgggatatagttgagagttacatcaaatggagttgccaccaacatgactgctaatggtgactctgggtacagaggacatggcatagtagtagttatgcagtaatcggaccctgattaacgatgaagctgatgatggcattgatactttatggagaactttgtatgtgtttttcccccatttaatccttacagtcaccattttcagatggtagctgggagtagtagataattttcccagggtcatattgcttaggggcaaagctgggatttgtaaccatgatgcaatactgcacctggtggatgtagtcagggttatcaaaataaagaaaaattgacccaaagatatattttagaggcagaaacaataatagcttagtaatagtctaggtgtgtgaactcgagacaaaacgagtaggaaaaagatggtttttaagtgacagttttggaaaagaagcaacgggggtggcaggaatgaacaatacagttctgtctcggtcatgtttatggactcttcttcctagagaacagccaatagtctttcatcagtgttgatttcatctttcagccttcagaaaacagctgtcaatccaagtgcttgctgtcgatatggagcacaggttgtgaacacagtgcctttgtgccatgctttggtcacatgtacaggtgttgactctagcagcagaccagtacctactcccagtggagctcaaattcacacatcacaccatcacattgtcttctcatttagccagtgaaatgattggcgtctcactgcagtagtacagtgatagtcattgattgacaagaccttctctgggaaggactacatttattctgatttctccagatcagacttttagaaccaggagaggaagtctgttcatggtcagagttcttgctgagtcaatgtagtattttgaaagctattgtgccaaggccccaggattctcagacctggctgagcaacatgtaactgatccaatttctcactgactcaggaggaatgctagctaaatcttgaatttggtactgtgacttcaatagtgggccagtcaaggggctcacgcctggtggaccaccatcccttcacccccaccccaccaaggtctgtctgtgcttggcttttcggactcatggtgaatgcttgaacctttttattcccttaacataaacttattcttctgggtaaaaaagtgaatcctatccccatgaaggatttgcttgattgaaatgagacccccccttgggagagaagtataaatgttgtgagcagagtggccttacggtagcttgctgacttcctagaggggtcgttgtgggaggagagccctgctagttccctttgccccaaattatttcccctctgtgcttgctacagaatcactaagtgtactgatagctcttaattacttctagttaaagaagagcaagccacctggtctctgaattaattagagcaatactctttaaaagaaacatcctcctttccctccttctttgccccccagcaaaatatttcctattagaaaaaacatatgaagccattggttagttttcacttcctttcctaagggatagtcagctaaatatgctgtcctgagagaatttgacagaagcagataagatttttgataagagttgaagagaaattctgggaagggaaggtaaattatactccctaataaaagccctaacaaacagcaggcataattggttgtgtatttgggggtgtgtgtgtcagtgaagtggtgtgtattctacataccaccagtgggaggaagaatgctgaaaaaagagaagtaggtgcttgctcaagacaggaaatataccacttcccttaggaatctgcccataggccatctttgcttatattatccatgcatttcattggcagtactctcctggagtgagaagtggtgtatgaagttggtcctaaaatccactcctcccatctccttcctaagagaaagttaacccactttgggctaactcaagagccagccagttatttttgcccatcactgtaagtaggattacagctcaccttaaatattggggaaaagtcctgatcatttgttcattctattagctagggccaggtgttgtcactgtctctagcaccgcttccatttcactcccattaaatcttagcaaattcctagcactctgaacagtgtattttacttgaatgattcccatgtggccagacttctgggagctgagcacatggtacccttttattgggtgccatgaggtaaccttggtaccctttggacattcagctttcctttgaggttatagctaattctctgatgaacatttaagtgggtggggctgtgtgttagccctactgtgtagcttttgtgatccagggaggtgtgaccccattgtggtattcccatagctgagatcataaaagcatcccaagtgtcatttggaagccaaacagtaggttacaaactcattttgggttaatctccctctccctaagctacttcatctccttgaatgctgctaactgtaagcttttatttcctttcctgtgttatcactcattaaagccttctctgacctgtataaatgagactggctttttcctcttagtattgtcttcgagcacttggcaggtggcatttggagccagagcctgatgaaagttgcccttgtgtattgtttttataagctaaatgagaggcacagaaagaataccaaaagatagactttttccctagggtaggaggaaaaaggaggatcaaaaatttgcagtttatgtatgaattttggtggaatgccgtttagagggaatattttctgattctgtctcttctcccttcagtcttatatttcctcttactttcttctgtatattttatatatatatatatatatatatatatatatatatatatatatatatatatatataaattagaaaaaaattgaaacagggccaggtacggtgactcatgcttataatcccagcacttgggaaggcagaggtgggcagattgctttagcccaggcattgaagaccagcctgggcaacatagcaagaccccatctcttaaaaaaaatacaaaaattagccaggtgtggttgtgtgcacctgtactcccagctacttgggaggctgaggtgggaggatcacttgaactcaggaggtgaggctgcagtgagccatgattgtgctgctgcactccaacctgggtgacacagtgagaccctgtctcaaaaaaaaagctaaactgaaatggaaattatttccatatcttttcttaaccaagtagtcaagtatttctgttgccattagtttggaccatatgaacttgctgctgttataggtcagaaatggttgaatagcagcaatctcatggctcaacctgttgaaccattaaccccaggagggttaatcagctagcccctttctaacccagcagatagaaaactatgacaaaactatttgactctactttccttccttcttatcttcctcatcttaaaaagttaacagatataaaacataaaagatatcattggcaagtcaaggtgacagtttttgggggtgggcaggtggcaacagacactaggacactaggacaatgaaacccagattttaaaacaaggatacaatagagccagcttctgtagaaattagtgtatttattcaccagtcattgtgtttagttgtctgagctacattgtattgtccttgaggagtaagaattgtgctatttttcattgcattcctgacatgcttaaaaaaaaaatgctgctacaatctactgtatgtagttgattgatgccgggaaagtttgctgcacctaacaatggtctttatccatgaaacactccattgatacttttagaactcattactgctaaccaaacagtagtggttttattactatactaatggagcctggtacttggaggctggggcatgggggaggaggagaaggtggggcaaggaatgtgggtaggactagtggatccctttccatgattaatggtgtcccccagaaaagtagttaggcagtttccaataaaacaatgtgataatctagatacaatgcagggtctaatgtgcatatgcaaggatgcactaaatgaattagccctaacagggaggaacaagggctttctaaataaagaatcagcaagacagcagagttttctatggccttctccaataaagtgatttgctttcctaacactgcatggaggcaaacaaatgagttgtgaaagatacggataccgatggacacagcaccatgataggcttggcagactcctccttgtgggcaacaagacagacccatgtggtgacttttatcctcttgcatgctttttgtgatgtacttgagttgttcttcttcctcactgtctttgtccatttaaaaaggatttttgtttttaggttattttatttggagtaatgcatctgtttgccataaatgtgattattgatgtacacgagcttatgtttgctgtcttacagtttgttttctatttgatctacctgttttatgtttttttttcctcctttttgactttggattaggcacagattttcagtccatttttcctatttctgaacctgctaactacacagtattttactcttcttgtggttatcctacagattataggatacgtctttgatttactacagtctaatacagactctttcacctctttgttttttgtatattgctttcctttggaaaagctcatgattcttaatgaatctcactgggggtggagtgatgttacccttatttcctacttgaatctctctcatagtagctcttacttgctgaacctgtttgtaactttcattaaagttattgcccagtatcacttctccgtggacatgtgttagtcagaaggggacatcctcaccgctgagctgtgagctccctagaataaagatggaagctttctggtttcccattgaggctgaaagctctttcatagcaaggactatcctgtctctttctagtatgacatctggcccacagtagcccctcaagtggagatttgaatgaccaggtccacctaaaccagatggccctggcatctggagagttcgaggccattttagctggagagttcgagctggagagttcgaggccattttaggtaagctcaagtctttacaactctgcaccttctaccagtccttcctagctgtttcttttggatgaagatgattcttcttttcctaactctgaggttgccctctttcatgtgcattcacattaactgtcagccatacctgtgtacctcaacactcactggttgctgcctgtaatactcttacaaaagatttaatgaagtgatggagaccttgggtgtctagcaactgccattgtttgtcaggggaatgtgagatatatgtgtgggaaggtccctgagttcctcttggacttatcaaaatatcacaaaattccagtacaaagtatctttccacagattcagctgtgctgtgggtcactaatacttgggtcattttaagctgtggtgcagaaacctacagcagaggtgtgaatcttcttccctttggcaactttatgtcagttctgatacattaaaaaaaaaaaacaaaaaaaccccagggattgatcatgttaatgtgaacacccacctctcagtgatggaggagtttttgaatcatgcaggttcttggctcggagacagcatggtctatacagaagcagcttggatttgtcaagacctcagttcaccacgcagctctgctgcattttgagtacctgtgggtaaatgacctcacctcttcagccttatctgtacaatagggatgataacactcagcttacttcacaggcttgttgtagggagaaggtgatctattgtttcctaaagctgtttttgaaaacggtgactcactctacagatatgatttgtgtcttctgttttctcctgcctgatgttttccattttggcaacttagaatctaggcatacctcaggtagagcttgctgacacactggtctatttttgaggtgggtaatactaatattgagttcaagagaattttttcccccctctgaactatgctatagttggtatctactcctaggatattaagtttgttccaaataagccagttgtgggctccatgctatgccatagaagtcagaggagagatagtgccgcctttaaacattgtaaactttcagagaaaagttttcccaagataaattagcaagtagtttcttcaccaaagggacatggttgatgtgaattgattctctgaagaaatatttaccatagctgcttctgccaaagtgaatgtggtcaccagggcaacaatggcagccgtctttatccagataagtgcaagagctgaattcagatgccccttcctagggctgccagctcatgtgaagtttggcatgcaggaaatggatgttcagtgttggcctcactgagttttggaaaaaccccacttattggagcatctgccaagcatggatggaggagggcttttcaggattgcaaaactacttctagagagactggtgagtagagggatagtgttatggacatacggctcattttccagaggtactattgaaactttcttcggtaaccataagggaagaggcagaagtcttctcatcttaccaggatgcctatgagagctggaggttgctggtgaaagaggatacaaagatacctccagagacagggcagggagtgtggtgtacttaccacatttctggaattgacttgggaagtggtgttcacttcttttatcaaagcaaaactagtaactaatagtaactactgactcatttattttttgtcttcagcttttatgaagaatgaactgactttctaatttctataagaaactgcaccagagtttatcccccactggagagggctgcttagatggttggcaaagcttccataacatctcagtttctctaacatttgaagtaaaagaccaaagctagaatcaaatatgttacttctttccattgcccagctgcagcttttacaaatgcatcacagttgaaagtgcctgaatctagagttgtccatgctgacttctagccaggccaggccagtggcacttctgtgatttggaggagactttcaatgaaattagattgtagctgctatatttaacttttaattatacactattgggatgttttaatttctaaagtgtcacagccaaggcatgaaaatgtggatcaagtaggcaaatggaattaaaaatacaacaacataacaaactctaacatccaccaattgtgtctcaggtaattaattagagcagcctgtagttactaacctgtgtggatgtttcactgctcgggaagaatagtcccagtgttttctagattagtggactgttccaaggagggctgaaataagtttcaacttgaatttgtagatctggatagtcaaaccttaacaatacaggcataggttgtcctctgtgggtatctgtagtgaattacaattctgtattaacttctacacgattacttatcctagtctcattagggaacacgaaattacctgaacaaaccataaggtagcatagacgttcaaatctgacatgtgcaaagttccttaagctaattagaaaatacacacattgatctgtgaatggatgcccttctgctcctttagggccagtgattgagaggtgtctgttggaggttggtgttgaacttgtgcttgaagtctccggatacaaaacttcacggttctggtttaagcagaagtcttcattgaatgacatcgatgtggagagaaaattccttggctttctgtcagctgaatctgctgatttgtaagactcttggggcaggttaacagccttgttggttgttgtgctgtgctgacagtgggaccaagcggggatcaggaaatagtctagggcattgcaaggttggatttgcttacattgaggtgttcctgtgatctgtgcacatcacccaaggtgatcagggccttgaggcttaggctgaaaggctggctttcgaggcaaaagatcagaaggaagaaaacatgctggcacctgatgtatatccccttttgctctgcttccatctacggttgctgcctgctcctctgacatgtaactcacctcctctgtgcctcatattgttagagctaaatttcccactgaacccagactgttatttttgacctgccctgcctatttatttgtgcaccagtgagtgtgtgagtaaatgcattatttttattattattattttttcttttgagacagagtcttgctctgtttgcccaggctggagtgcagtgtcatgatctcggctcactgatctcgctgattgaacctctgccttctgggtttaagcaattctcatgcctcagcctcccgagtaggtgggactacaggtgcttgccaccatgcctggctaattttttgtattttagtagagatggggtttcaccatgttgcccagggtggtctcgaactcctgagctcagataatctgcctgccttagactcccaaactgctaggattacaggcataagccactgcacccagcaaatgcattaatttttaaaaattatagcagctcttttggaagaattgaaacatagaaaaattaccccttagtccattgcatttacatggtgattttctttttcatttcattttttggccacgtttttaatttttattttttgctgtggtaaaacgttaagataaaatttaccatccttgccatttttaagcatacggttcagtggcattaagtacatttgtattgttggtggtgcaatgatcttcaccgtctgtgtccagaacttttcatgttcccaaactgaaactctctacccattaaacagtaactcttcattccccccaccccttcccctggtaaccactgttctccttctcagtccccatgaatatgcctattcaatgtaactcataagtggaatcagggaagttgtgtccttttgtgtctggttgatttcacttagtataatgttggtaaggttcattcttgttgtagcatttgtcagaatttcattcttttttaaggctgaacagtaatactccattgcatggatagaaacctcattttgtttatctatgcatctattgatggacatatgagttgtttctacctttaggttattctacataatgctactatgaacattggttacaagtatctgtttaagtttctgctttcagtacttttgagtatgtaactggaagtggagttgctgaatcatatggtaattctatgtttagctttgtgaggaagcatcatactgtttccacggtgtctgctgcaccctagcaatgcacgagggttccgagccctccatatccttatatgcttgcaaaggatatgtgtcttttcctttttttttttttttaataatagtcattctgatgggtatgaaacagcatctcattgtggttttgatttgtacttatgcataggttttttaaaactatgtttaaacagagtgtacttatttttcatccttgatcagttaatattttgtcatgttctctttttgcctttcaaaggactttttttgttttttattatatatggacaaattatagttgcaaatacttaagggggtacaaagtgatgtaatgatgtttgaactcaatgtggaatgattaaatcaagctacctaacctattcacctcaaatatttaacttttttataacatttgagattttctcctagtgatatcgaaatgtacagtatgctattattgtatttaccatgctgtggaatagccctcaaaaaaggaagaaattctgtcatttgcgacaacatgagtggaattagaaaacatgctaagtgaagtaagcgaaacacagaaagacaccacatgttcttacatatgtgggatcaaaacaatcgaattcatagaggcagaaagtagatgagtggttaccaggggctgggggaaatggtaacgtgatggtcaaagggtaccaagcctcaggaggagtaaattaatttatttttgagatctaaaatgactaattttaatagcttttttctgggatccatcctgaagttaccagttttctgaagaaaagcatttgaaccaagaatccaaatgtgggcttcactacagaaaggagaaacacagggcaaaactgtgtctaggcgcccctgagaccaccccaggaggactgttgggctccctgtgacctgttttggaactctgggggagctttatcagggaatacacttgctggaagctgcagaatatgggagagactccgattgtaacaggcaagtttctggtgagacaaaaatggattaaaccaagactaatgccaggcatcagagacagcaaaatcatccaatttatcatccttccctcaaggctgagaggtttttaagtagtttggaaaaacttggaaagggatagggaaagcttgagaataatttaaaaacttgtcccctgcaggccagtttgctaaaagccgagttttaccaaaaggctaaagcagtaattaaagcaaaaagcctttgaaaaggaatcttgaactaccccattaacagagattacagggtatggttagtaaacaccagagtatttaaaagagagtagtgacacagaaatgaatgccttgtgaaaagacgaatttggtcaccacaaattatagaaactttcagaatatacagagaatgcctgtaagccaaatggaactgttggtagaactgagttaaaaagtgttttctgtagagtttcatttgtaaacgtgatttttaagagtacaagctgaatattacttaaaatgccagtaggaaaaaaagtcacacccctttcctagtaactgctttttgaacctgaagtttttggaaagaagcatcggtttctgagtatgatctgaaagtactggctttaataaggtctttctccgagaattgttgcttatcttacaaggcagaagtgacaaggatggtactcagcactggggcattgggtatcaatggtgagctcatctctgtttcaggaaggagctgaccagcgacatctcattccaaaaattgccagatagatgcagcactgagctgcctcccaggtcatcccaactgattaatgtggagatctgcagactaaagcaaagagaaaagtgatttgaatggacctgagggactttatcctccactatgaggttgcagggggtgccttctgtgacggtacctttgtaagttattacaaacctactggtggaaaaaccttgactgagttccactctgaatcccagttgtagaagcatcatgaaattgagcacaggaaagactaggagtaggaagaactgggtttcggactcagatttgcctgttattcgcctgagatgtctggcgttggttgcttgcctttctgcaaggattgtagggtaccgtccaacgcatcttgtatgtggggacattttggaaacacataatactgtgtaagcattgttattagtaggtaaaatggtaaaactgaaatgaaacaacgccctgcccagccccgccaccctaacaactcatttcccctttaggcattttcttgtcagtgggtacaacacttctgtcagtatctttggctctgaggaagtcagtggaatgaatgacttcaagtctttgaaaaataaattcatggcttactgtgggcagtaatttgttttatcccaaagccggtaatgtgaggtatttgaaccaaccacaaattaattatcctactatatttgcagcagtgttagggttacaggtacaacctaagcaccattgccatatcattctgtttctggacaattaataacatgcaaccgtgttgggacaacaaatcagtgctaacctctctggggaaactcaagtgcaattgtgagatgtaaatctccatccacaggctctgcaaagggggaaatataggagtggctacttactatgtgaaatgcacagacatgactaagagtagagagttgtatattctgcctcccaaaatcctcctcatgtggctttctccaaagccttctcagaggacactgaattcacctaggaacttcgagaaatgtgagatgattcaattctgttggcagcagtgcctttcctgttactgattactggctacccgggagctcatttcctttgtactgagtcatgtgcactcagagagatatgaccagggagtgatgttatagaaattgcgtaagtgtagagaaaaggtttggttcccttattttgcatgatgatctctcactgtgcattttattatgtttatatttaactatgaagtaattgctattactgcactactgtgtttgatgcctaccctgtgtcaaacattaggtattttacgtttattatctccaatcctaagtaatgccttcaagctaggtaggtttattgatgaggaaaccggtgtggataggtcaaaataaactgttttaggccatgcaggctgaatttgaaatcatctaatcacctttgtaaatctgacagggcctgagctctttaggtcaaacctgctgcctcccatgtttaggggaataggcttaagaagttcagggaaagtacttgcctgttgaggcatgttttcttagttacaaagggcttaaattgttttgtgggtatgtgaaacattcttcccagaagctgaaagcctcctagggattccctcgttctgtgttttgcccattctttaagtcacggatgcccaatgtgaagagatcacatatgttcatgatgccccgtgatcatcattgtcatgctgttgcctgaagggggaccaggaatagattggcatcctggattttgtgacttaatagttgattcattggataaatggttgtctcattctttttttgttaatggctttattgaggtatactttaaatgccataaaattcactcattttaaagtatagaccgaaatgatttttttgtgggggagttttccttgggagacagggtcttgcactgtcacccaagctgaagtgtaatgacaccatcttggctcactgcatcttctgcctccgggctcacctcaagccatcctcctatctcagcctccccaggagctgggactacaggcatgcaccatcacgcccggctaatttttgtattttttgtagagacttgattttgccatgtttcccaggctggtcttgaactcctgagctcaaggaattcacccgcctaggctcctaaagtactgggattacaggcgtgagccaccgcaaccggccttgaatgatttttagtagatttacagagtggtgccaccattgccacaatctaatttggaaatacttccattgccccaaaagaaactttgcaacagttgtgtcagttttaaactgctcttttaaggtacccttctctgatgtgctattaggttctctagctggctatgaagaagaagaaatcatctttgaaaattatttaagtaaaatttttttattttaatttttgtgggtacatagtaggcatatatatttatggggtacatgagatgttttggtacaggcatggaatgtgtaataatcacataatgtaaaatgggatatcttccctgaagcatttattttttgtgttaaaaacaatccagttatattatttaattttaatcaaacaatatagcactcaccatatgtcaggcactgttctaagtgctttgtgaagattaactcattgaattcgttgattcctcttgacacactttgagaaaggtactcttaatatttgtattttacagatagagaaacagaagcatagaaaaggtaaatagattggccagtgtcacagagctggtaatgatggagttgggaatcaaaacgtgttattctaagcactctaaagcacctgatgagaccagaaagaatgggggaagcagtagctaactagatggatggaaggcatcaggaagagtaaaagccagtaccttctaggaaacagccagagcttcagatagccctgggtctcagatgccttagtacagaataaaataagatccgataaatccatcctggtggtctgcatggcatttgtcagtaatctaggattcctctgtccatttaccctcctcttctttgccttggtatcatagggagcaaaacatgctttgatggacttttgctttctatattggacctcagagagctagagtgatgtgcttttgaggtcccttacctgagggagttgggggttgggggtgtctgtgttctggtcaaaaggtccttggtgaaggtctgaaaagcctggtctggaatgatctgtgggaggaactgggcccattgccccatatccttagcccacctccttcctcttcttttgcaaatggttgtattatagttggtgggtctgcccattaaccttgcctattttgaagcctgggaccttttctttgtttagggggaaggccttttgatctcctagtgtgctaggattctggggagggaagctcatgaggctggtatagtcattaagttcagctgttcactaaaaattacctttctctgaatttggaagatagcaaccatgatagtaattccctctcggcctcaaagggaaaatgaccactctagtttttgtttagcattcccctgtccttagggcacaaaaaccttgtggaagtattcggtggtacacatgaaggaacccgggctgggtgtctgtccacctttgtatttagtaaatataacggattagcgcgttttggtgggaggaaaatttgactcttcatacttaatgtgtaatgtacttgggatttattaattgattgatttgctgcttgtgttttttgggcctaccatcttttttttttttttgagatgtagtctcattctgtcacccaggctgcagtgcagtggcatgatcttggctcactgcaacctccacctcctgggttcaagtgattctcctgcctcagcctcccgaatagctgggattacaggcgtgcgccaccatgcgcggctaatttttatatttttaacagagacagggcttcaccatgttggccaggctggtctcgaactcctgaccttgtgattcgcccatctcggcctcccaaagtgctgggattacaggcataagccaccactcctagcccgggcctaccatctttttattctaccaagttatgcccctccatttgcttctggcagactttcatccagttcaagacccttttaacttatcaaaggtcacaagaagatgctcaagagggaatcaaagtgagtatgtggaatgcagggtattctgtcaaaactgttagaatatattaaaaattggaaaagccaaagcttgaaacactatgtctggtataacacattagttgcccataggaacattttgatcaagtgatggcattgatacaagggcgctgagtttgtgttgttaattcacttttaactcttcatgtatcatttttgttctagttgtaaactggaagaaatttttggagctgaaaggaactttagcaaaccttcaaaatcaacctgcttattttacataagtaggcattgaaacctaagaatggtcaagtcagttttccaaacccctgtaaagagttagatgaaaggagcagtccagttttctgggttaattttctggtgctttcgcatcctgaaaatccaatatgggccttattataaagctatagacgggtctatgagatctttctaggtaagagtgctatgtgctatttcagtaaaggaattggagacagagttatttgagatggagtaactgccaagtggtcttataatttccctccattctgtcctggtgattaatcctaaattggacttcagaattctcagttcagtgtgataaaaatgttagtaaaatctctgtacatggcagttatagaaacttgtttattacataatctttttctgacaattctgttcttaaatatctttggcttaattttcaaacaaaaaccaaaaataaaaataaatgattggtagtccttctaatacttgttctaattatactgctttttaatgatcaaaaaagtattttaacaaaacagccatatatcttaatatgccagaaccacttaaagttctacagtcgtgtttataccaggtatttttattgtgaaacatgccccaaacacatcttgagcggagctttaagtatgtcttgtctataacattggaaagagatatgaaccctcctttggttaattgaagtcaaggtgtaatgcctttgtggtttcccatgtgtttctaatcaatagttcttggcggtttccaaacgacttcccccatcccatctctctggtatgagcacttcaggaaacaaactgtattaactttggccagaatacacagagagggttgcaggaccttttagcaattttctgtggaggattctctgacctggtaggttgaatatctcctctgttagcctttgggtatacgttgtgatagatttatggtagggataaatcatttccaggatgatgaagaagttttaacatctacctcattgtgttatataaaaatatttaagtgttatggcatctgagtaaatggagatgggtgacagggagaaagggagtgaggaagagaagctcagggttctttaggccacaatggaccttgagctgtgtgtcattggctatttatttttgtgtgtctgtggctgaaatgctctccagaatagctgtaggaataacagctgttattaggagtaagtcagacagggtacttgtgtatttagaagaccttttaagcactggtagcagcctagacaagcagccggtagagatataagacaatggcccctcggttgtggttgccatagcccttagtatgttttatcacttgcttagagttttgttccaaaggcaggagccatgtggcagtgcactttcagtgcctcaagcattgtttgtatgtatagttcttgaaaattcatctcactttgtcacgtcacaagatgaatacgtactcagacttgatgtgaaatgctttcttttgatcatcagtgcagacacagtggttcgacttcattagtcagaggtggggcccagatactgatgttttttcaaagctccccagatgattctgatgggcagctgatactgagatttttttttttttgagaaacacagaagcatataaaacaacaatctgttttgcatatatgcagtacttggtatttagaaaagctgtttatagcctattcctattgtcaacttgaattaccataaggaaatatatttaaagtttagccttatcacctgtttgcattaggcagtggtctctaagaagcctaacaggtatttgtaagaaaagtaaattttaagcacaactcatccatctaaagaaatacataaaaaatcaagcatttgtggcccatactcttcctgccatgcccgttggtctctacctcatggctcacatggcatgtaatagcgagtcagtgtttttgttttacaaaatcctcttccaactcctcgtaggagaggattgtatcaacctggtttgtttctcctactctgatgttggaacggttaggagcaggaaatcattctgattaggtcccaaactagcataaaatgaaaatcagtgctagtaacccctgagtcctaaaagataacttacaggaaagagggaaaccagatgggaagtttaaaagcaggagaagttaatgctttaaaatcattgtttggctgggtgtggtggctcacacctgcaataccagcactttgggaggctgagatgggtggatcacttgaggtcaggagttcgagaccagcctggccaacatggtgaaacccagtctctactaaaaataaaaaaattagccaggcatagtgttgtgctcctgtagtcgcagctactcgagaggctgaggcaggagaatcgcttgaaccctggagacaggttgcagtgagttgagatcatgccactgcactccagcctaggcgatagagtgagactccttcttaaaaaataaataaataaaatgaaatcattttttgttgttttaatttccattattgtctttttttttcaacataacatctctcttaaaaatgagactaaaactttcaaggtaatatgtgaaatgaaaacatttcaaaagggtagaacatgggaagacaagacttcctcctcttcatgtaaattctatcccccagtattaacgtttgagataacctctatgaagcttcttataaatccttccagaatcgtgtatgcagtcaagcagggcccctgggattagatatatggattgtatttagattatagtaggaatgactccccctgggtttgtgcagtgcacatacccttggccacacgtggtcaccctatatgcagagtatactctacctttaaaacaatacaacataggattacattcagtgtactgtgctataccttgcctttttcaattaacagtatataatggaaactttgccattgtctttaaaggatattgtcacactgccaaattgccacattccccctttgtaaaaggcaacacctatttaaattaccagtggtgtatgagagtacctgtctcaacccattcttgccaactttgcattttatcaaacttgaaaaatatttgctgattggtaacatattcattccaaaaatgttttaagtgacttctgtgtgcaaggcttcttgctctatcctgcaaaacaaaagcaaatcagaaccgtgctttcttcttttctagatgtctgtggtttaatggcagtgagggacaaaaagcaagcaaaccacaatttacaattattttatgtacagatttatcatggaaacaaaggggcagctgtagtaagccattatagtttaatgtaaagtttaaaatgccatagaaatatgggttattgctctttgtgttgcctgcagtatttttcttctcatttgtaaatatattttccatttagtttcttgatgtcttctaggttagcttattgcataatttaagagcctttttccttttgctgcatcaaatatatggtagatagccaactttttaaggactctcttttaaaaaccttcctgaaatgataccattttattctttttgtaaagacccctatagaatatctagggaggttgagaagtttctagtattttgaaataagaatttatagcaaaccctgtgttttgactaattgtgttctataattctgtgatgtggctattggtcataagtcattagtgactttggatagagatagttcgagtggtggggtagaaagtgtttctagttataatatgtcatatacctcaaggtctagtctaatgtctgatgccatttttctggtctgtctagagattcatctaacactgctgcatgaaaatagttaaagcttgcatgttctcacttacaagtgggagctaaatgatgagaacacatgggagcatggtggggagcaacacacactggggcctgttgtgtgtgaggagggaggaggcaggtgggaggagggagagcatcaggaagaatagctaatggatgctgggcttaatacctgggtgatgggatgatctgtgcagcaaatcaccgtgtttacctacgtaacaaacctgcacatcctgcacatgtacccctgaacttaaaatagaagttggaaatttaaaaaagccttagaggaacaaaaaaaaaaaaaaaaaaagaaagaaaatggttaaagctgaagacagcacgcagtgtccgaccaaatgtgtccatgcagagctgtccctttctaggccggtgcccctgccttacattgtgtgtaaactcttgatccttttctagagcctagtgaagggtctagctgtgggaagtggagcatgaactggaaataacttcctgcctctagcgattcatttttcttttcagcaccatttcagcgatagaggttttactgaaatttaaagagagaaaggctaaaagcttagtatttcaatgtgccagctattgctgacttgcagtaaagaactgttgccgaattaatgtggttggtatttactgacagatcccttagatagcccacttcttttgtctttttttttttgttttcttttcccttctaagacttctgtggcatctatcttcaatttgtcttcaattttggggaaatgctctttcttttttaatttctaagtttttagaaattgatgctctcagatatgtctgaattgacacagtatgatggggatctaagacctgcttttgtgcctgggagccatgaacgttacactaagcagtcgaaatttctgtgctgtagttttcttctctgtaatatgaaggtgctgggataaataatctgacatcttgcttattcagctcaacaattctgtgcatatattgcatttacacatctatcttggatttttaaaagatgtggcataggtgatgggttgataggtgcagcaaaccaccatggcatacgtcgtttacttacgtaacaaacctgcacatcctgcacatgtacccctgaacttaaaaacaaaaaacaaaccaacaaacaaaaaaagcagtggcagcagatgtgtgctttgagcagttggttatattgaaatttttataatactggttttatcaaattatgactaattatcccttcacttgcaaaataaagtggttttcattttctatgtggaagtcaagagactgtactgtgcttgagttttggaaatgagttctcacgttagtccattttagaacttgcgaccaggctatcctttgtctcttccttgacagacagcagtgggttgccaacgtgcccttgtgtgcacactcaccttttctcttctctttattaatgttctgttataggcaaaatgaacattgtgctgaaggtgtgttaactcatttaattggagatgagtgaaatatcattttctaatggccttctgcatgccttagagcccaggcctatggggtacgttgaagacgtgaacattgtaatgcaagttaatgtttatatacctactttcacttccattcatctctttctttaaaggttgattaaagatttatttcaggccatgcacggtggctcacgcctgtaatcctagcattttgggaggccgaggtgggcggattgcctgagctcaggagttcgagaccactctgggcaacatggtgaaacctcgtctctactgaaatacaaaaaattagcggggcatggtggcacgtgcctgtagtcccagatactggggaggctgaggcacgagaattgcttgaactcgggaggtggaggttgcagtgagccaagatcatgccactgcactccagcctgggtgacagagtgagacttggtctcgaaaatatatatatatatatgtttatttcagcaaattctggaattatgccctcccctcccccctttttatttttgctgattgatgtttaaaagtggaccattaaaaaatgtaattccaagattgccttgcatctgttttgaatgattgtgttttgctttacaaggggcagaatgacttttggggccaaatgctcagctgactttttgttcgctgttttctgcagggatcttgagaataatggttctttttaaggccaattgttactttctttctcacacaaaggaaaaaagagactatctttaggaaacactgctttaaatcatcttccttgaatattaattctctgttgcttcctccaaaaatggagaaaataatccctaccctcataggcttattataaggctcaattatgataatggtgtgaaaactttgaaaattagacttcagagaaattgagttaatctgggattatttatcaatgtcttagtaaccaaaagtttaaaatgtgttttgtttaccaactggttgcatgtacatggttaatccaaaaggctcagcttttcagcaaatggaaaaagattaacttctttatggatcacattatgagatgaaacacatttcattctagctgctgaaaaaatagcaacatgtttttgaaaccattgtgattttgtattgcagtcactaaaacatcaaatatatcatttttatgttaaagtgccctaatttgtgttgttacataaaacttggagtaccttgaccaaatagaagaaattaatgtgccgcgtgtctgttttaaagatgaaatctgagcccagtgtgaggctcatgcctgtaatcccagcactttgggaggctgaggcaggaagattgcttgagtccaggagttggagaccagcccgggcaacatagggagacctcatctctacaaaaaataaaaaatagacagacatggtggcacatgcgtgtagtcccagcttcttgggaggctgagctgggacaattgcttgagccagagaggtcaaggctgcagtgagctgtgatcacaccactgcactcctggtctgggcaacagagtgaaaccctatctttaaaaaaaaaaaaaaaaaaaagatttgaaaatttaaatcttgagaaggattctgaagatttttgagaaaatattttattcctctctctgttatctgtgtgtatgtgtatatacacatacaattttatgaaatgtggtttatgtgattgttttcagtatttggctaatatctatgtaaaagaaaaatgggcccacaggctgaatatgtgttttctcctcataaataggggactggtggttggttgcatttctttttttttttaacagtctcagatgattctgtcttcatttccactttgctcccattctggcattgcctgtgtggattgagcatgtgaaagcttgacatcatgattcaatcattctctgattttgcaataattcaaagcagagcggaagcattgtgaaagaatcatgccagttttcttaaggtctgatacacccatcctaatttacagtattgttctaaagatgcaccaggaaacacacatgcatgcacacacacaccctagtgagacatctgaggggatttggctgcctcccgttcctttcctgtctcctccctttgtttccagatgcatcagcagatggccgtccaaagctctaaatttgtaccttgtgtgacctttagcctggagaaaggcaaatttattctgaggatagacttccctgccattgcaagtagaccttctgtcagttgttataaataaactcaagtctttggatgttccttctgaggttgaattggcatagggggccgttaattaaactgtagcctttcttgggactctaacaaattttaaagatgagtaagacaacattggaggtactccctgatagtcctgcagtgtaggataatacaggagaagctccaggatccatctcctgagagctggctttgcagcgtaggataatacaggagaagctccaggattcatttcctgagagctggcttcaaaagaagttttcaggttgcatggcaggcattgacatggactttggagtcaggcagacccgggcttgagttctgcctctgctctatactagcagcgcttacctcatggagctgttagcattaaatgaggaggtatttatctatctgtcatttcccagaactgatccaggacctaataggcgctgaataaatggtaggccacttaattttatatcacaagagcacattcttaaatctttattcaaggacaggaggccctggaactaactaatgaaggaaagggaaattgctgtgtgccatcaagcagaggatcagaaaaagaatatgagaataattttattagcacttacaattcactgcgtttcaactattgcaaaataacagtatgcaagagtgtaggttgtcttacagaaatgatgtgctcttgtttgtggcagctcattttaggggagaagtcatctaggttaccatgtgtttgtagagcagaagacttaaaagtggacaaaggaagttggcattattctggaggatagaaaatcaacccaacttctcttctcttcccaccactggactctgggtgagcttgagaatgggaagtcttttctgttgcctagtgagtcaactcttaatgtagtctaccgtggacatcagggttggtctgaatgtaaagttgcatgcccctggacacagtgcttgggtgagagatgacagaggaacagctggacaaagtaaatggggtgagaataatggcctggaggtccttggggaaaacttgtcaccaccttaggttggctgtgactatttactaatatgagctgtgatcagaggctgagggataaagcaggccaacatttccttttcttcttattactgatttcttctagttcttcccccataattggccccaaccttctaaagaaaaggctctgcagacagcagtgggggaaaatcagtctgatgtagtctggagaaaatctttgtcctgccctgttttcctgtagctttgaaaatctcaaatgcaaggccaaacaacgaattattattaacgtgatagaggaaactggtactattaatgtcatgcaaggagaaagcccattttgagtagaaacagaaggacatttatgaggggaaagttggctgggtagggcaaaactgagtagtagaaaatttaactgtaattattccattgaatttttttagaaggactcttcaaattattgaaagttgcttagtaattagcatagtaaccatttacaaaatacactctgacctagagcaacagggaagggagtcagagagacaagttttgtgcagactgtcagctacagcaggaaagtatgcacggtgaatttccacgttaggtcaggcccatgtaaaatttacaaatggcagggggtatggaggaataaaggcattagcattgcatatgacctggtggccctttgaaaactgtgtttggggtttatgtttctagttgcagctaaatctgaatttgaggttttaatccttttgaaccaagctaggtctaagaattagacatttgatctcatgcatcttatccagcacacaaaaacttgagtgcttccttggcttggacataagctggatcccagctggcccctgattttagtttctgtgaagtgattagtgattaggtggcaccatggtaaggcagggtgctgtggtggcagggtcttccccccatgcagaagggcccctgcagaacacagcagtaagttttttaactggcctactcctgcttgccccagagggctgagaattggtttttagatagctgatttgtttgttattggctctaattaggcaggtaggcttagctcctttaattattcatgctactttgcggaagcttaagctacttattcagagttccagggccaggacttgggtgggaattctttggcagggccagctgcagaattagcattaatgtgatactaatccctgggatggcccctcagagcagtgtacccaaatgtttgtttttcacatctagagtccacaaacatgtgctcagtaatgtccagcaggctctagcactcaacatctagatggcatggtttatggccaaggagctttggagcattggtcaaagtctcaagcagagagatcagagatacagtctagaaggtattcttatatttaatctctctctggaggcattggactcatatggcctaaattttttgactcagatacctgtacatacatgtacacccctcaccttgctctcttcacacacttgtttaagggaaaatgaggccaggcatggtggctcactgctgtaatcccagcactttgggaggctgaagtgggtgggtcacttgaggccaggagtttgagacctgagtgggcaacatagcaaaactctgtctttccaaaaaatctaaagggcaaatgggacagattatgtaaaaatcattcagaaaataatttgtatgcagcaaaattaactatatttagatatcccatgttggttattatacctgggtatctttttcttctgtcacttatgcttaagatttgtcttcacgtatggtaaatacctgcataccattacttatgagatggctttccacatagttagtgggatgtacactgatattaggatattaggaagaacctcagaccaagtataaatggctgaaaaaaaaaaaagccctcacaagtgatggtgtattggtaaaagtggtaaaaagagatgagaaggtctctagagcgtctctcttgaatatagagattctagcattttaattttgttcaaggtgggattgacagatatagctagttgaattttcaggaagtaatagaaaaatagtttaacaaaccaaattgctaattatgttctcagcgaattgctgtaatattctggtgttttattgtgtgatattttataggagttagaaggatcttgactgtccctttctagaaaaaagtcagggtgcagagactttacgaggtggcccccaccacaatactaccttgacccagcctggactgctggttagagccccaaagattgttcccttcattttaggtttcctctatggtgctatagcatgtatacataaaacattgtttataccactaaaagacgtgcttagttttttttttttctccatttcattcactgaagatacctcaaatgcaaaacaccacgcggtattgcaatcccgtgcttgataagttcaggccttttccaacttcctcaccccattgctttttttatttttcttttttttttgagacagggtctggctttatcacccaggctggagtgcagtggcactatcttggctcactgcagcctccacctcccaggctcaagcctgctgactagctgggactactggtgcacactactatgcttggctattttttccaattttgtagaaatgagggtctcactatgctgcccaggttgaactcctgaactcaagcaatccgctgacctcagcctcccaaggtgctggaattacagatgtgagccatctctcctgacctacacatactaatgtaaaagttgggaactacatggtatctactataacacatctcaaaatttcagtggcctattgtgactctgacctaaaagctcagcatagatgttcttggcaggtgggttgcatatttctctctttttgtgccttactattccctggggctttggagtcctctgaatctagctggcctatgaaaaagagaggatgaaaactctccattttgccacctttgcctggaagtgacgtatatcacttcctccagtgtttctggtagtgagaaatagtctcagtaacccatctagtaattgatagaaatggcctggtaaatgtagtccttggcggaaagctcctctccagtgataagttcatagtatgaagggggaagtgggaattttggtggacaagtagacccctctgtccacgatatttatatgttccaagaatctagattgggcaatgtcttagtttgggctgaaataacaaaaataccatagacttggtggcttcaacaacacatttctcacagtcctggagagtagaagtccagcatcaaggcactggcagatctggtgtctggtgaaggtatgcttcatggtttgcagatagctgccttattgtctcctcacatggtggaaagagagaccactggtttcttcatccttttataagggcactaatcccattcataagggctttacccatatgaattaattatttcccagaggccccatctcaaaataccatcacattggagatttagagatcaccatatgaatttgtggggtggggaagagggacaaaaacattcactccatagcagatgatatggatactgtggagctagacatttgatttgctgctctgtacctgacatggagcaaatatacctcttggggtatatttcaccactggccatgcctgtttgcatagcttgttgtcaagattaattgagaaagaatgtctgatagtatactgagcagagaaacttactgtaactgcaaagcagtggtagaagaataataatgcaccccccctgcggtgaaaaagatgctctagcccagcaataatggtattgacttcatgaaaccacttctgacctgcggcagattgctggattgatttagtgctgcttttttttggaaacaagccttgattatgcctttttacagtctatcagtttgtgtgaaactgactatattttacagtctatcggtttgtgtgaaactgagagcaaccctggtgactctcatggctaggataccatggtaccttgataagaattccagattcaaacaacagaaacaaaagtgacacagtagtccccctcttgggcagtcttcaagcacatcttgaagagttatatagttggtctttgaatatcactgccttttggctgtttcttcgatttatataaaagaggccaatttgaagccattcactcagtactgtatcactcacatctgttgtaaaaggcattagaatctgtggagtgaggaaaaaacagagcctttatgaaatgtgcgcttgaaatgagagatgtttgtcttaaatttggacaggataaataagagacttacatggaaactttggaagctgttttagtgaaatttgcccttaaggtcttgtcttattccaaaatgatgaggcagaatgcccaaatgttagcatttgacatgtgaagaaaaggaaaaattggataaaaagtgaagaatatgttcaaatttctctatacaagcattagagaatataagaaggcctgttcagcattgggtttaaatagggaataattaggaaatggtgtaatgtattatttactcactgtttttctagggacagtcattccagaatcaaaatcaattggtcagcttcacctggtagctagaagtaaaagcatggcaaattcagatgccctcaagggccacgcaggtaaccttaagtgggtgatgcaggttctaaattagagtggggaatggacagatcaagtccctggaggaagagggagaaagtagatattgaagcttaatgcagaaatacaggaccagtgttgttacgtcttcagacttttaaaggagactgaaatataggtggtttttttattttttattttttgagacatatgacttttaatgtcagctcgggtgttttgaggtactgtgtaggtcagtgaaaaattgtctgctagtcttaattttcctgagagctacctgtctgtggcatctattttagtggccagggaaagcagatttgcttcttggcgcgggatggacagggagggctctttggtttagcaacatattctctgagtaaacaatcaggctacatttttgcagtcatagcgtcagggggctgatgccatttttaatcacttgtaaagctctaggggctatatggagaacctactgttacttgatactctttcataaagtaaaattttatttactttataaaaatgccataatcatcagttgccggcacttatgtttctagtacccgagattaggaaatcaacaaaaatggtttatttgggattggaaacataaccaatttaagatctctttagttacttgaaaagaaagtagaaataaaaggcattcagattcttggctggcctgtgaagtggaaggaattcagtttaattgtgtgtgtgtgtgtgtgtgtgtgtgtgtgtgtgtggcaatagctaattgtaatgcaggtttaatgtccctatctttttagtaggtttggcttttggagaaaaaagttgcttggtgtagaaaataattatgtcatatatgaaaatggtcaaaaatgaaatataatcaaggggagctgttaatagttttgcatgtctttaaaaaactgctagttttattgaaaatttatcaaacttaacctttgaaaataagacaggttattattttcaaggttcaaggtttatttttcccaagagaagacaagttttgttggatatgtgtgtgttttggttttttaatcaagccaggtttcattttcttacttttaagtaatggatatatggtaattaaataagaaaacagattaaaaagacaatttttacctaaaagatttgttgaaacctgaaagtgacctttgtaagtcaccatcttttttctgaaccttcatccataaattgggaacagtttcctctatcttgcagattgttctttagcattaaatgaatatctgtgtaatgtgcctgttgcaatacttccacgtaatagggactcattcctttctttgctctctttgatcctgaagacatcaaggagggtgctgactccccatactgatcctagctggggaaagaatatagcttgggctacttttgttttggggtcatatttaagttaatttggtctagtatgccgtgtctgtggttcttgggcatcagcatttacccgttttatgaaactctctgtaaattatagccatatagcaggtgcttagagtggtctcaccgttaatacatttttaaatcacatttgtagattctggacagaaaagtcaggaccttaaccaccagtagaaagcaggtaatgaacttgtgtgtactgccaagtgacctctctactgagaacatctaaggataagccacaaaatgagaagtggacgtgaaacccctttggatcagcctgccttaactaaatggaagaattggggctttactgcatgtttattattattttatttttggtaggcaccaggtctcgctatgttgcccaggctggtctgaaatccctggtctcaagtgatcctcttgactcagcctcccacagtgttggattagaggcgtgagccacaatgtctggcctttactgcatgttaatttggcgtttcagcagccaactcagctgggaagttgcttgcttgttgggaagacatgggcaagagaaaagtttgataaatgtgcatgctgtgactttatgcttgcaaaaaaccaaaatctcacagttgtcagtacagccataaatgctaacatctacttctgcttcttgacaaatgcattgctgataaggacaagggaaatggcccgcttgactgtgtttagggtcaggaattcttccctttgccttagaataaaaaatagtgttttcttggaatgttaagattgaaagtgtcttcaccggattcaatttctgtgacatcagttctagaagccctccttgatgtatatgggtagttcacaacagtgagtaactgtggttaaaaaacaaagaagagtaagttgttacaggtagaggcatgtagagaacacattcttattagtgccggaagtccttatccaagagtctgcatgcagaacacagaggtgaatttcattctttttctttgaagcattttcttaatcttttcacatcaaaatgagggaggacttttgtgggaatgatgaaaacactacttatgaaagattgttaagttcttatttgagtctgaaatatgactaaatcttgccagcctatcagatgcagttgaaatgggaacctctgcaaaactgtgggaatcaaagaaaaactgccttcaccttgtctttttcaaagaaggggatgtagggaaggcaagatcctcttcatgactttttggaagggtgatttctatagtcttaacaacatttgtagaccatgtaatatgtgcagagcactaaatgggtttataggtaatgaaattttagacttggagttgaccttaattgtaattttattcaacctgcttattttgaaaatgagacaattaagaggaagtttactgcctctttaggaagttaaacagctacacatctttataaatatttttgagttttatgatgtagcaagtgattgatactcacaagcacacccagcacattcaaatacagaggatctacagagcattaacaagttcgctagataatagtgatacattttctaggaagaggtgggatttgaaccaattttagtaaaaaggggaggaaagacagagtggtagtgcatgcatgtagtgctagctacttgggaggctgaggcaggaggattcttgagcccgtgagtttgaggctgcagtaggctataatcatgccactgcactccagcctgggtgacacagagcaagaccctgtcttaaaaatgggggacaggaggccaggcgtggtggttcatgcctgtaatcccagcactttgggaggctgaggcaggggaatcacctgaggtcgggagttcgagagcagcttgaccaacatggagaaaccccatctctactaaaaatacaaaattagttgggcatggtggcacgtgtctgtaatcccagctactcaggaggctgaggcagagaattgcttgaaccagggaggcggagtttgcagtgagctaagatcatgccactgcactccagcctgggcaacagagcgacactccgtctcaaaaaaaaaaattgagagagggacttggagcagtagagttaaaatagatgagaactgcaataggaaatgagaattggtggtgtgtgataatttgtgggatcagatattgagagtgggagttcctaccagtgtgtgtctgtgtgtgtttgttttttaaaataggaaatggtggctaggggagttttttgtgttaaatctgtgttgttggagagtttttggttggtgaggggggccagggtgaccagatgaggaaccgacaaaatttagacacctgagaaagaaagggaggaaatggactaacatattctcaggtagttaacctcctcagcgtcacctactggtccttctgaatgttatcagttcccttaatgagccatgcttctcacttctgtcctttttctttttttctttctttttctttttcttttttttttgagacggagttttggtcttgttgcccaggctggagtgcaatggcgcgatcttggcttactgcgacctccttctcccgggtttaagtgattctcctgcctcaacctccctagtagctgggattacaggtgcctgccaccatgcccagctaatttttgtatttttatgagagatgtttcaccatgttgtccaggctggtctgaaaagcctgacctcaggtaatccacccaccttggcctccctaagtgctgggattacaggcgtgagccaccacacctggcccacttctgtcctttttcatatgctatttcatttactgataatacctttctccgtacccccacccaaagcttgagttattgtctgttcatttgtgtgtttagactttattcacccttcattttaggatggttgtttctataatacataaaagatatctacaaatttgacctttaatgtaggaacaatgacaaaccactgaaggctttccaatcaggagagtgatgtgagcagatttatatttaaaagcagtggttcccaagctttatgttgcatcagaattgtctgaagggcttgttaaaacactaattactgggttccatgctcagtttatgattcagtaggtctgggctagagcctgagaatttgcatttctaacaagttcccaggtgcagtctgaagatcatactcatttagagggatcgctcgggccgcagcaggaatgaatgggcatttgtgggtggttgggcaggacaggagcagggcaaatgacctgaaaaatgtatcactatttcaggtaagaaataatgatggagaaaagtgagtctgtccagagatacttatagacggtagttgattagagacgagaaacgaaggaggtgaagccggggtttctggcatggggaaccagatgggtggtggtgccattcactgaaatagggagcactcaatgagcagattttctgagagaggtcaggaagcaggatagtgatgtgatggtgtgtgtggagacctgcaagtctgtcggtgcactagccttcacttcagtggggagaggcttctaccactttgggaaccatcagtttgggattgatagttaacccattggagtagatgggattagctaggaaggtaggtgagaagagcacctgggacagaatgcaaagggtcacaactcattaagggaagctagaggaagaggagaaggaattgttagagagggtcacaacaccagaagtgtacagtgctattgtggagaccaagaggaagatgtgtttagaagggaggagagtagagctgggcgtggtggctcacgcctataatcctagcactctgggaggctgaggtgggcggatcacttgaggtcaggagttcaagaccaggctaaccaacacagtgaaaccccgtctctacgaaaaatacaaaagttagccgggcgtggtggccggcatctgtaatcccaggtacttgggaagctgaggcaggagaattgcttgaacccgggaggcagaggatggagtgacccaagatcacatcattgcactccagcctcggcaacagagcgagagactccatccaaaaagaaaaaaagaaaaaaaaggagaggagagaaacagcatcagttgctgctggggaatgccaggaaattaagtactaaagagggttcagttgagttcacaacatggaagtccgtcgtgcattcacacagtgctgactcagcctgctttgggccaggctctacgctagacactgagggttcaaccatgactgagattttcttccagtggcttggaagaagcagaaggcagccagcaatgggttaggagggtcaggacagaaactgactatttaagcagtaagttccagaagactggaaggagagagggcagccgagtagagggtggggtagctgggggattttcacgatgatgatgatgatggaagagacttgagagtgtttaaatgtaataggaagattcagagggagagactgaagatttggaagggagagaaaagctggatagaggcatgtccatgggagtatgggatgggaaggagaccaccgcccagaccctgcatgggtggtctgcatgactatcccacaagaaccagcttgatatttagtctgatttgagggtgcttaaaggccccattcgggtttgcctcacttaggtgccacatagccttaatttccagcatgaaagatttattcctttggactactttcatttagagatatgcaagatattcctggggcaggcaggataacacattacagaaatagactctaacgagcaagtaaatacttagctcccctttatcctaatgggaggtagtgagcttgcgtgctcaggaggaagagactgaatcctggagtctgtcctagcctgcctagtttcagttctgatttagtggagacaaaaggccctgtatgattttaacatagttgtggcagctgtttccttgagatcagttcaataatggtattaaaatatgatagagtcgattgaatgttcagcaagcctatgggtaactcagtgtcccctgctccaccatgtgtgaggttacaaatgaggtcatatgaccatcaatattaaaatgttgccagtaattgcgcccacttagttggtaggcaggatctcagtcctcttcatgacccctcttgattctctctgagggcatcatacatggttcacaaacagttctgtcgttctcctctggcaaagccagttgggggaggtatcttgctgttggcactgtggttttccataaagatggaaagcatctgcccaggagtctccttgaatcccaagttgcagaactttcaaagagccagtttgtgctgatactattgatcctgactacatcagagtctcaattctttaaagaaatggagtcttttacactccagtctgtgtttcacctgtgtggctaacgtgggcaacagtgtcttcttcttccactgtcttccccaattctgtgatgcttttccctgtggaaactgagtcatgcagtggacacctgggaaacgcccttgagattctgccaaagtaagaatctcacttttggtgagtactcccctcctcccagaataagagaagccttgtattctgtaaattaaacttcagtttaaatgtcctagaccactattgtccaatggaacattttataatctgtgccgagtaaccactagctgctgagttagtgagtgttgaaatgtggctagtgtcactggggaactgaattttaaattttacttaattttaattactttagagtttaatagtcacaggtggttagacagtgtagctctagaccagtggtttcgaaattttatcatgcatcagaatcaactggaggacttgttaaaacatagattgctgggccctgtcctccccaaagtttctgattcagttggtctggatcaggggttgaaaatctacatttcttacaagttcccaggtgatgctgctagcctggaggaagccacatttgggaatcaccactgtagactttgttctagtatttaattaatatgctaactcacacagatagaattgccatcagccagtcgtcagggttccgggtcagctggttgacaagcagcctagtacctcccctcctttcccatccctaaaccacactggcttcttttttccaaaaacattacagctcatctttaagggtgattcatgatactttctaaacagccacagtagctgaaacattggactactggggaaattccagccttgaacagactttggttttcattccagttttactaatttgttctctaatcttacaagaaattagaccatgtgtgtggcgcatgtaggctgtgagtaattttatctttgccaagctcatacttggcattatagtcagtgatttctgtgtccatgctggctagcctgggctcagagggactgtccctaaaatcattttttaatgagtagctttttaacccaatggcaaaatcatttttaatacttacaaatacggtctaataaatattttttttagaataacagagcactgtcttatgggtgattgtttatacaaggtctttctcaaaagcatattggaatatttacagatgaaatgacatgctgtctgagattcactttaaaggcctggttgggggatggtagctgaaaccagattgcaaaatgttgatgattgttgaagtatacatggaggtgcagtatactattctttcaacttttgtgattgtttgaaattttacataataggttaaaaaaaaagcatgctcttagagaaactaaatacagcatctttgtgaagtaccaggtaaataattgacattaaaaatgaaaagtagtttgttggttttgttttagggaattcaactggataaagaatgtaatggatgatctaaaggaaatggaagagaatagcaattgtgtaaatgtaatacattatagaccattgttaaggaagaatctgcagatatgcaaaggacttcgtatgtgtgtatggtgtttaagtaggggaaatacacccctactgatttttctgtataccattatagatatctcttcttaacagttcgcaacacaactggtgctcactgtgatgtgtcaaagttttatttgatttggacaaaggcaaagattttataaatttaataaagaggcaggaaggagggaaggaagtggtaagtcataccactggagttcataggcagctaaacttttctgggtggcccagtttagatttttttagtaaagagatgatatttaccctgaaagagaagagtttaaaaaaaagagactttgtcaatcttctaaaggttgtgtgaataaactcactttttttttttttggagacaagtttcttactttgttgcccaggctgtagggtagagtggtgagataatagctcactgcagccttgatctcccaggttctagcaatcctgctgcctcagcttctccagtagtcgggattataggcatgcaccaccacacctggctaatttttaaaaagtttttacagagatgaagtctcactgtgttgcccaggccgatcttgaactcctgagctcaagccatcctcccaccttggcttcccaaagttttgggattattggtgtgagtcactgtggtcagccatcaacttatttttgatttagaaaataatctcagattttcttcagctagatggtaattgaagttgagtattttaaatttctttgacaattacaggaagcaaagaagtggttttattaaatagcagtgagcttcatgccattttacagtatgtaaccgagacccatgttttccttttgatgtagtcaatttgttaccatctttttccactttgaaatgtctctttaaatgcattttcaccccatttctatcttacatcaccttcaccccctagtgcaatccctacctccctctgcctggattactgctgctaataacttccttactggatagtcttccctcaagaagtgtcctttcccttccctttcctccagtgattttccttttctttgactgtcgtttggaccaaacgacttagcatccatttgttcttccttgtgtgtagctttttgtttgccagttacataaaaagtatgcctgtgtattaccatatgatatgacagtaggtatataacagtgctggtcttcagttgaaaatatttataaaatgtaacaagaccactagtctctttagtttttaatacttaactgtaatttgatagagaataaattttccaaaggtggcatcttcattgatgtattactcacaagcctgcaggttgaactcatggtcatagatgagtttccacatgttttctcctatacccattgaattcgtcaaaacatacctgactgtatgtgtaagggagctgcttaaagattttggcagtataggtttttgcacctagcatttgctgatttcttaaaaaaaaaaaaacacataataacagaaggctattctgtatctatttcagcactgctgagtgtttaagtatttattgcttaattttaaatttttggataaaagtattggataaaagttgcttagaagcaacttttagggagttgcttctgagagtgtgttcaaagggtacctttgactcttgttggagtttgagtaatgttcaaacaagagtaacataaaataatcctccagtgatctgaaattgttaattgtcgggataagcatagactgtcctcttagttcaaaccaacagactgaggaacttgttcataaaactctcttctttgacttggaaagacagattaaatgtggagtaaaactcctcggggttttctcttttttggactgtcagtatggcataaaaggaaaccttctgtaaattgaatactatctgaaaccagatgcactcatcaaagcatttgttgaactcctatgcattaggctctgtaattctcgtgaagccttgcaccattttcagcattgaatttaaaagtaggtcagtgaccacagtgaggtaagaaaaacattttttgcaaaaagaaaatccttggagagtgctgctttgataagacgtttaagctttccctcagatagctgattacatgcgtgtgtccggatttcctacatctctcatgctcttgtcccttgaagagtctctgaaatacagaactgtttagtgcttttaagccatgcactttgtgtttgtcgagaagaaaccaaaagacctgtgcctggcaaagccatgttgaagcctctaatgtctaattgtctgttggttaagatggcactcagtagtcaagacccaaaacactgaactcaccaagcaagcacaacagaaggggtgttcaatatttctctttttgtaaatgcttttgtgcctcttagttgctagaaaggactagatgatgtctgttttaggcacacttcttccttctttctccctctggtttctctctctttagtttctctttccggaactatgggatttttgttgcatgatagcctcttagatgtgtgatcttcatgcttaatatgcagtgatatgcagggaacagattctgggactacttttttcctttttttctctgctcataggccttggtgtatgagattccttttcaggatttttctaccatctaatggatttctgcaaaattaattaacagtgtaaagtttctcaaatttttttcctgacctctccccttaaaatagtctgtagttttatggcaggacttggggggctctcatccttgcagggaagcaccggtcaaggttctcatggtaagtgcctctttgagaggtttaaaattacatgcttttagcttccagagaggagggaaaaccttccctttaggtccgtatcatttgagaggaaacttggggttgaataggctaaatgttcctacttgtggccttgttttcactgcttggttacctagtgcaaacagattaatgtaagagttacggctttttagaatacagacagtcgtcaaaaaaatccaaagactttagaaaatggaatttgcttgtagaagaagcttctcagatactggtgtcaaacagctttgctaaagcattaatgtggctacatgtttgacagactgcataaccttcctacattttcccagagtagtctaatgagttatcaccacctttatacattccatcctacatagaaacctttcctcattcaaacagatttcaaggaaaaaggtcataccctattccaaatctacctgttgcctcttctatactctcttccacttttaagtcctctgtaacaacggctccttctgtcaccgacatagaaatattccagtttttgaaataggcccgcaaggagtttcaatcactgagagcttggggaataaaaactaattttaatatttgcattaaaaaaacaattagacaaatatattgcagaaaattatacacatttctaaaccaaatgcataaagcctgtattaatcagaacttgtagttaagccttgtttttttctttgctttacattaataagaaagaggcaagacacaagaaaaactgaaggatttaacaaatcaacaacagtttcccttctgattaacataacgaagtgaggacagagccagctcagttctctccttttgcagtgttccgtggagcgtggagacaacagtaccttcaggtactaaaggcttttcatgttttgtagttacagcagttagaaatttagtaagacatttcagtgttatacttaaagatgaaaactaaaaagcttttctgattttaattagattgtttattcgaaaaaccattcattctcctaaaatttttgtttaaaaaaagattggctcatcttcattatccagactgctgcatataccatgcacagccagaagttgccatagttagaggggccaggagcagagccatcctcagctcctccctactcctcccttctcacttaagtcagccccatgtggcatctcctcctgctgtctgacctcccatcgcagtctcctctgcctgacttcactgtctcctgcccaagctctcacaaaagctcatagcctcttacctgtccactcgttccttaaaatcattgacggttgtcatctttacaaacaggacaagatcatgaggtgatgtccctgctccatgtgtccattacccatggcggtggattttgaaggttcttctgggatgtggcaggtcgctgggtctccaggtcatgcccttaccccatcctcagttggcacagctctacttttgttctgccttctacgcttggagtaagattttgttgaataaaacattccaggttgtagaaaagtttgaaaaccatgggaggagataactgctaaaatgctgtgtctttccctgtattctgttggaggtgctaactttgaactcttggacttcagtttttttttgttgttgttgagatggagtctcgctctgttgcccaggctggagtgtggtggcaccatcttggttcactgcaacctgctcctcccaggttcaagcgattcttctgcctcagcctcccaagtagctgggactacaggtgtgtgccactatgcccggctaattttttgtatctttagtagatacggggtttcaccatgttggccaggctggtctcgaactcctgacctcgtgatctgcccacctcggcctcccaaagtgctgggattacaggcatgagctactgcaccctgcctgtgttcacatttctgacacttcttcagcttgaggggtccatgctaattggatccttattgtgaccagtgtttttatgcatactaatttgtttaatctgtacctgattgacataggtactaatatcagcaccgttttatggatgaggagactgaggcacagagataaaccaccttgcccagggttctatagtcagtcagtggccaagttaggattcagaggttggaggtcagcccgcttgctccggagtccacactctgaaacactagactctcgaaacaaactgaatacattaacataattaggtggcttttccagacttttgagtggaagaagtacagccactggattcctctttctacagacttcagtttcgattgtgggctgaatgtgccctcacattttgataagcctaggcctgtgtggggtaagtttggagggaaaagaattagagcaggagagaatacactgtagagaaaagagaggaaagaggtcattttccccaaacccgaaagaacccaggcccgtgggctccctggccttgatctgaagtctgggagccattgatttgtatgcccatttcatttctcatgccaggacaatgccacagtcactttgacctaattgtatggctcccctgttcccttcactcttttcatcaaagtgaatacatttgttgctttggcaactcgaggtgttagaatcttttttctttccccatccccgaaagacagttgagggacttgctccccgaaagacagttgagggacttgcgtgatagattgtgaagaaaaatctgggaatcatttaaattagattttcaggaatatgacttatctaactctgagaagctgggcagaaggcagcctcctcgcctgttgactccttcctgcctctgctagcatttcagaacaacagaagcttgcctggatcttttctcacacgagttttggtcctggagtcgccattggaagtctagtcagggttgtcaccttactgttgtaggcagaaaccactacgcagtgggttgaaggagcagaaacttcttggcaaaggcgaatcaatgtgggttggtaggaatttgcactcctcccccccctagttttcttaaaaacactcttgtaatgggacaaatgtgactgctcagaagttaccacaggggccttttggaatattttcatattcccccatctgtgggaagtgaggggctattaagtatgtgtgtgtgttggtggggagcagtaaccgagcaactcctttgctggtgggaggggatgccatgggccaagggattcctttgcatacctttgtcgagggcccgatggggagggctgtcgatggggagggctgtcgtaccaggtgagatgcaattagccatggaagcagcagtgtttggatctccagctctcagtccaagtataaaccagagttaagcctcagtgtggtgctggattagaaaggaaatatggctgaatggccgggcgcggtggcttatgcctgtaatcccagcactttgggaggccaaggtgggtggatcacgaggtcaggagttccagaccagcctggccaacatggtgaaaccctgtctctactaaaaatacaaaaattagctgggcgtggtggtcagcacctgtaaccccagctactcgggaagctgaggcaggagaatcacttgaaccctggaggcagaggttgcagcaagccaagatcgcaccagtacactccagccagggtgacagagcaagactctgtcttggcgtcagggggtgggggtgggggtggggattacagaaagaaagaaaatacggctgaatgaaaggtcaggagtggattctgggccctgactgacccagtgtgattcacagactccttcattaggagcagtctgctcagaaataccctttgcgtatatatttaaaagagctttctgtgtcatgtttgaactgtgacttattggggattattaacacttggtggggaagggagggaacaaagaatcctcagcccttcatcttagaggaggggacgatccagtttgtggattgccaggacgcttgttttgtccccttcctcccctgctgcccagccttctggctgtattactgcttatttgcctctttgttagagggagaaacaaaaggagttcagattcaatgcctgcttttgtttttgggttagcagctttggttgaagtttagctgaatgagagaggagagggaaaggtaaagactgagctatctgttaaggttattgactaatttagattgtatgccattctgtcccttgcatgctgtctgcgagggcacagccattataagcagagagtgaaaagggagattgtgtataacagaaagccaaggcgttagagcctaattggaaacaatacatgccccaaatgtgctctcgtgtcctagccaagaacatggtttcaaaaacatgagaaataaggataatgaaatgaaaaacactttagaaagcttagatacctcaggtattgtattgtgggggaaatgaaaaattaagtattagatttatatgttttctggctgggcgcagtagctcacgcctataaccccagcacttcgggaggctgaggtgggtggatcacttgagggtcaggagttcgagaccagcctggccaacatggtgaaaccctgtctctgctaaaaatacaaaaaaatttagctgggcatggtggcagatgcctgtaatctcagctacttgggaggctgacacaggagaatcacttgaatttgggaggcagcggttgaagtgagccaatagcataccactgcattccagcctgggccacagagcaagactctgtctcaaataaagaaaaaaagtgggttttttctttgcagttgggaaaagaatatgaaataaagtggcaaatatggctcatttgattattttcttaatctttattttttctcttgtattaaatttaagactgtagacttcccactagatcttggagacactaaggtgaaaatcttcacacattaagttgaaaatatctcttttgggtgggtgtaatgtttcacttgtgaaagaactgttaaaatcctgctggatcacgggtagcatagggtgcaaaggcacagaaaaagctcatttttactgaaggagttttagagcctatgtcaggtgacaaactttgtctatttctgccaccttcctggagtatttgctccattgttggcttgctgtgaaggaatgtgggcagaaagggatgctgggagctcttcattaagatcaaggcctagttcttcaaggactactgaatgattggacctttcatcagcatacaagaggaagggattgagagtgtctgttcatgccattgatttaattggtcagagaaagggccaaagaaggggcaataacctcagagaagagcactgactgcctgtagctgttcttactctgattctcagggcattcctggaggagctccagatactgaggggaagcttgcatcagtgctgcgtcagggtgggaaaagcccatcctgataccttactttgaagtagacatgtcattgagagggtccccaggcctttgtgaggagtcctggatggaggaagaaactatgccacacagaagtcctggggatgttcaaagctggcctcagaggttttcttttcaaatgagcatccctggaactgggagacagctctttcctacagaagctgagaaggggaggtcaggcagggagggcaaggggaacaccagcaccagaaggcagacagaaaagaaaaaaatgaagcagatgggaagtacacttggaaagggtgggaacagggtaggggctggctacttaaaaggcaagaggatcaaggcctcgaggagaaaaagcaaataaagaaggaaatggaatcaaatcagatgaagtccttttaggggaaggatgatgtgaacgaaacaaacaaatcaacagaatgaggaaaggcacgggtgaaaccaccagaggaaagttccagccagcacacaggagggaggaaagctcttgtttgaaatggaagctgatgctctaaaggagcattcagggtttggagcaacatttagatatgggggccactgaagcttccatttgtttactgagcacctaccacaggctgggtgctgtactaagacttaacaaaataaagatgaatacaacacagttcttcatgggactcataatggatgacaaacataagcaggtagcttttaaacattaccataattgtagtgatatggatatatatttcatgtcatatcatatttttcttttgttttttgagaatgagccttgttctgtcaccccgcctagagtgtagtggtgtgatcatagctcactgcaaccttgacctcctgggcccgagtgatcctcccacctcagccccctgagtagctgagaccagaggcaggtgccaccacacttggcttattttttaaatttttgtagagacggggtctcactacgttgcccagtgtggtcttttaactcctagcctcaattgatcctcccacctcggcctcccgaagtgttgggattacaggcatgagctgctgcacctggcttcatatttttcttcattggatgatgcccacaaagtttcagtgcaatgtatgtcttgactaatgcatttgaatataaaggtagaacattagataaatgctagaagggaaggtttgagtcagaaattttgtcctttctctaagctccctaaaggtgtaaatttatttgacaagctcttattttgatcaaattttctttccaactatcctctcactagaaagaggaagaagactttgtgttaactcaattttttagaattgtggatttggtagatgaggttgaaaaggtaaataagtgatcaccttgatctcttacctgttttagtgagtcagaagcaagaagagtgctagaatgttgattgattgttttgtggagacagggtttcgccatgttgcctaggctggtcttgaattcctgacctcaagcggtcttcctgccttggcctcccaaagtgctgggaatataggcatgagtcactgtgcccaagaatgttgaatttaacacattgtctgaaaactagatgagtggcttcttgcttctgaagaatgtgatgtgctgcttgattcaagaccgatttataatatgcccttcagtttactcttctttgttacaatatggagagaagtggtgtattttgaaaacatttggggccgggcgcggtagctcacgcctgtaatcccagcactttaggagactgaggggggcgaatcacgaggtcaggagtttgagaccagcctgaccaacatggtgaaaccctgtctctactaaaaaaaatacaaaaattaaccaggcgtggcacctgtagtcccagctactcaggaggctgaggcaggagaatcgcttgaacttgggaggtggaggttgcagtgagccaagattgcgccactacactccagcctgatgacagagtgagactccctttcaaaaaaaaaaaaaaaaaaattgctacaaaggaatcccctttgggggagtttcatgattaaaatatttttgagtgacactatacttgctaccaattctggttatgataatgtgtagcttttagtgcccgaagaatggagttgactgttaaacagtctggtaaatattggaaataaattagagttgtggacaagaagtaaagaaagttatcagagttggataaggaatttggagagctcagagggagatggtaaaaaaaaaaaaaagttgagaaattaagatttgtttgttagtttattgaatgtctactatggtaggatctagcaaaataaagatgaatacaacacttctccatggaactcagaatggggtgactaacatgaacaagtggcttttaaacattcccatcattgtggtgatatggatttgctctaagacttcccttgtttttcaagataagtgaggctgggagagaagtctttgaagctgatgttagatgaagatgtgctaactagactggtgcctaactatcccttcttcacacctgtgactttaagtctccaaagtagtgacacttaccacacagacttcagggtccacattcaacttaagaaatctctctcaactctttgtggtgggtggatgtggatctgagatcacagtgtatagcagagaagtcctttgtaagaaaaaaatgaccaaaagatgtatgttttctattgctactggaacaaattaccacacatttaatggcatgaaataacacagatttatcattttatagttctggcagtcagaagtccaacatgggtcccactgggctaaaaccaaggtgttggcagggctgtgttccttctggagggctctaggggacaatctgtttcctggctatttccagcttttagaagccaccaccttctttggcttgtggcccccttcctccatattcaatgcaaataatgtcagggcaagaccttctcatgcttgcatgtccccagttttttggctacaacctcagaaggttctccatctatgaggattcatgtgattagattgggcccacccagataatccaggataatctcactttcacaaggtctttaactttaatcatatctgcaaagtctcctttgccatgtatggtaacatattcataggttctggggattgggatgggtatatctttagggaccattattctgcctatcaaagaaggggggcttggccctttctgtagtgcctgtggctctctaacccagttgaatgggcctctatattagttttccttcagatttctatacctgtaccataattgctagacagccccatttgatatattattccctgactcagaaatactccttggcttggcactcagagaactccatagtggggtccttaccccttcttatcttagtccggagcaataactctgttctggttggatgtgtttactcactgttgcccttcattccctgttctgttgactgcacatttctgactccctgcctgggtcattccttccaaaccagaatgtgcccttcccttatttctgcccattctttctatgaaatcctgcgacattggccatcctcactccacatttggagtttatcataattacctagtactgttatttaactttcacaagaatgcatttgctctttccatctataccaccatcctaaaatacttggtaaagtcagtcttgggatttaccctcagagacactgattacatgttctggtatggggtcaagaagtttggcatgaaacggcctctgtgggtgatgctggtataggtggccccacgtgatgctgtgcgggaaactccttgagggaggataattgacctttcacccagagtgataggcatcatgctttacatgtaggtggaggttattatatttctgggaaacgataccagttttctgaaggcaagttttaatgaagagagtgtgtcttgtgggaagtgtgtaatagagttaagggcaccaaactgtgcaccatcgttttggaaccaactgctgagtgtgaaaattcaaaggtgtacagagagtcagtctatgtcccagagtggacatggtaagacagtacagttgagaattggtaataaccattgtaatggcaaaatcaccaaacctctagattttttttgtttactttttctgtgtttcagggactttatgcagattatcaaaagcagaaattttgtcatggaaaagatttgaaaaaatggaagatggccaatttttgagaacatatggagagaactctctgctttcagtgctcattgtgataactagttcttcttgatgactggaatgcaaagaacacccaaagatctgaattcgcactgaaccaagcatttttggaatgaggtctttcatgaatatgccatgattttgatttctgcttttgttaagactgcaatggagcctttgttattttcttgattccctgaagagttctagattccctgaagagttgagtctaagtgattgatttatatacaaaattgattttgcctttttacgttattttgggatcttatagcataaaataaaacttactaataggcatattaagcaaaatgttttttgtttctttcaattttgtgccttttattacttttcctatcaactttatagacgttgaaagggaagacatctgttttcattgagagaagatcttttaaaaaacgagctatttcagagttcctattataatagggttctacctattgtaaataaaagaagttaatctgggccagatgaggtattaaaaataacagataactatgtgaatacactaaaatctattgagttgcatactttaaatgggtgctttgtatggtatgtgaaatatatctcaacaaagctgcaaaagaaaaaatacataaataggtaaaatggaaaagaaaaaaaccccagatgtttctgtgagctcttggaagctgtcacagtggtgagacacttgttttagaaatcaccaaaattttcgtttgagtccctagtcaccaaataaacataggaaattttttcatattatcttttgttgaaagaagagctattttaagataaatcatgctaggcactttaataacagtgtttgagtcaatttaagtcagttctctatttaactattaaatataaatattctgtgaatcaagtaggctgtgaaaatttatgtccttttcgcagtgggctcatttatatacgtagtgggcatattatgttcatttggtggtctgatgatacctgattgaaataacccaaatgggaccaatagggacaaagaatagcatgttctatccatgtagaactaaattgaaatattggtaattaatgtgtttatttggtttcatatgtttgaatttgtttttagcagccattatatggtactgtgtcctgccagataaaagactgaagaaagttatcatccaagttcttaccgtatgccttgcttctggatgaaaactgatttgtcacaaagctcagttaaaattcactacagtgtaattttaacaaacttgagagtggtcaaagtattttggccttgtaatgaattgagccagtatttgttgaatatctttctttcccacaactgccctcttcatagagcaggggtccccaacccccgggccacggacctgttaggaaccaggccgcacaaggggcaagtgagcaaagctttgtttgtgtttacagtgctccccatcacttgcattactgcttgagccctgcctcctgtcagatcagcagcagcattagattctcataggagtgtgaatcctattgtgaactgcacgtgtgagggatctaggttatatgctccttgtgagaatccaatgcctgatgatctgttaccgtctcccatcacccctggatgggactgtctagttgcaggaacacaagctcagggctcccattgattctacattatagtgaattgtataattatttcgttatatattacaatgtaataataatagaaataaagcacacaatgaatgtaatgtacttgaatcatccccaaaccatctcccccttgcctccccactacctggtccatggaaaaatgatcttccacgaaaccggtccctggttcctggtaccagaaaggttgggggctgctgctgtagaggataagaaaagagtaatatgacctctgccttcaaagaattgataatttggaacagagctgaacaatagaaatatgtgaaccatatgatgaactttaaatttcccagtagccacgttaggagataagaaagaaacagttcacctggttagatagatggtgaagaaaatgagaaaagaacagatttcggaattatttttaatgtattttatttaacccagtatattaaaatatcattccaacatgtaatcaatataaagattactagtgagatattttacttttttttaaacatatgaagtctttgagatctggtgtatgatttactcctaatgcacatctcaatttgatgttgaatttttgttggaaatatttgatctgtatttagattataaaatttagagtcaaaaaagtagattcacataccacatttgttccagttatacttaaaagtttttcaataactgagtcaaacatgttttaaaatctgaattaaaaattaatttaaattaatattaaaaattcaattctttcttcaccctaaacatatttcaaatgccaatagccttgtgcagctggcagctactgtatttaacagcacagatatggatgttgagagaagacttttctacctttaatacttaaataatcaaggtgatatgtaattacaaaaagaattttgttcttcttttgtataggatggttttgtgctacagactagctagagcttcactgtctaatagaactttctgtgatgaaaatgtgcaatgttggcacagtccagtccagtaaaggtagtcactagccctacatagctttttttctttttaatttttttgagacaagatctctctttgttgcccagcgtggagtgtgatgtgcaatcactgctcactgcagcctcaacttccaagtctcaagcaatcctcccacctcagtctcccaagtaactgggactagaggtgtgtaccatcgtgccctgctaatttttaaattttttgtagagataggattttgcttaagtaatcctcctgcctcaacctcccaaagtgttgggattacatgtgggagcccttgggcctggccacctacgtagcttttgaagacttgaaatgtggcaagtacaactaggaactgaattttaatcttgtttatttcaagtgtgagtagctacatagggctagtggctgtcgtactcaactagagactcataaaggagccacaatttgaattagtttaggcagtgagaaaatgattaagacattaggagaatagcttagaccagtggttttcaaacattactgcacactggaattatagggggatttttaaaaaaacctctgattgtctgccactcccacacattctggtttaattgatggagatgacctagtcattcggagtttacaaagctccccaggtgattgtgatgtataacaaatttgggaacagatctatgcttgtattataaattctccacaaatctatttccttgctattcatattatatgtaagtttgctaggaacaagaacaaataaagaaggaaccacatcaataccttgtgtttgctagattcctaagactactacatatatactcttaattgatcataccctgtgcattagatggggtagaaatgatcccacttggctaacaaaaagagattcaaaggttagttgacttgctgaaggtcacatagctggggggtgatggagtcctgtcttaaacctggatctcatgtttctgccaccacataagcagagaaatgtagcgtatccagcttcctccaattcgtggcttgttttctctctcttcataatagagcccttgtgcttggatttataaagaatgtttcttttgatatttagggggaaaaaatctcattaacaattggatgtttgtagtccaacagattcgttatcctctaaggggcactgtgttgggtgttagcagttctctgctctcttcctggtacaacatatgatcttggtgaccttgggttagccagttagcacgtcggatttctagttgttagaagaggagttatcaaacctgtttgttctatctcttaaaggattgttgtcaaaaaatatcattgctttgtaatggagaccaacatttatacttctgcagttatacttgctcctgaaataaatttttttcttacctttttgaaataatagtttttaaaattgagccattttcatatgttagacatgaattaattcaaccctcacaacagccctgggagatagggcctattacccttctcttggtgatgaagaaatcaaggttcagtgacttgctgaaggtcacacatcttattagagacagagctgggattagaaccaaggtggttttgcttcaaagcctatggtattatctgctccagagaactaaatcatacccttgtggcctgagtgcaatttgcctttaataggatgtttactgccttctgcattactggtaccaaggggtggcaagatttcactagtgactttgaagttcccctcttagacttgtaatagatggtggatatttcctcagtcttagataaaataaaagcatcttcagaaaatattgctactcatgtgtctcaaatttaggagcagtgagcttgccatgcaaaggtagctttcagaccatcccctttccctctcccctagtttttctaataggtatcctagagctcccggtactactcagccaggatttaatttgaaatgagttagtttataatgaattgaatgttgtttttttttctccctggcttttcccatttggagaaaaacacttcaaacctagaacaggtatctgctttgtttgatggttaattttctttcttcctttgtgtgtgtgtatgtgtgtgttttgagatggagtctcgctctatcacccaagctggagtgcaatggtgcagtcttggctcactgcaacctctgactcgcaggttcaagcgattctcctgcctcagtctcctgagtagctgggtttacaggcatatgcaacgatgcctggctaattttttattttttttggtatttttagtagagacagggtttcaccacgttgaccaatctggtcttgaactcctgacctcaggtgatccgccgaccttggcctcccaaagtgctgggattacaggtgtgagcccccgcactcagccactgatggttaattttcaaatgtatcttcctcctctgcttttctgtgggtgccaacaaatagaatggtgggtttgtttgttattcttaactcctttggctggctttaaacatgttctctttttagccttatttttctaaaagcttagtgcagaaatttcttgtttggcttccactcttcagggtgtgataattcccaaggtctctctctagctcctcaggaatgtacccccctgatggactgaaatttgtccactccagtgaaattgtttgggggagaagggagcagagtacacgttcaagatgttttctcccagcatttgtctgttgatgagcttttgtaatttccatttcactgtccttgccccagaggataaccttggatctcagtgtagactagattgagtgtaaaatgagttagcacaaatgaagtggaaacagatcagcgtgtgaggaggaggctcagacgctaaatcctctagttgggtaaagttgaaagcattttcctcagagcctccctgggaatgcttgtcctatttctcagagaaataagctactgtgtgcatgttgttgctgttgatgcctttgacatttgtgcttagcgaagtggagggttctgtgggggataccaaaaaattgccctaatctctgtcctcaggaatcttattgagaaggggagatgacctgattgctagacatccatctagcttccctctgctaggcacgagatgtacaaaggtttaaaaagagccatgaatgctaacttcttggcttacagcttagcagggaactcagccatgacttgtaatacagtgggatcagtactaccatggcagcatcaacaagaaacaagtgcgatctcatagccctgcgcaagtagtgaactaccagcaaagtcggagaggcttcatagagaaggggagttgagcagagttctgaaaagactcccctctgactagtgggacagggcattcgtgcaggcaagaacaccctgtgcgaaggcactgaggtgtgaagcagcctggtgtgttggtgagtgctccacaagagccatgtcagacctcaattcagtgctattttgtgtgttgcaggcaggaggttcaaaggagcccgagagcaggaaggctgaccaagccagatttggaaatacttggctgggatgttcctggtcagtgggctatttgggcaaagtggttaaagtgggacaaaggcacagggaaggaatccatggagggaaggggagaaatggctcctttagtatcttgaatgaggcttttggatgtgagtccaggtacagtgctatagtttaattgcttttgcttctgtttctttaaggatacattgcacttaaaccccagtaattattccagattttgttagtggatatatccccaccccccatctggctcaagctaagcagttggcataagtaggggaacagaaggctcagaattgtccactggaagtactcggcttttctttggagagatcaggtttcttccatgggaaaatgatgtcaacacacttatcttagcactttgcctcgagggcacctgtgggcttgcgcctagagcaaaggaaaggggttccctaaaacttcctttctgttttgggaacatggagatgtgatagaatatccctgataaaagcatcagtttatggtggaggtgagagtttatgaccaggaccagaaagttgctagaaaggttgctaagtggagaattatggttggttattttcaggaagcaacttaatgttgtgggaagaagcactggactaggatttgggaaatttgaggtctaatcttgattttaccttaactaataagatgatcttgatctttctgagccatggtttcctaacaggcaaataaggagactggttaggagactcaagagagcatatagcaggtgtggtaaaccatgcagcactttatagtgtgaggactgtctgaaccctgtcacttggcgcctccatccggacaccacgtgtgccctcctgcccgctgcgggggaggacatgcccctgatgggtctgggctgcactggcctctgggtgactcattggcgttttgtaaaccaccttatctttgaagaaaatgttttccactactagtaaaatttctttcttttctgtctttatttgtttctctttaaagttttcttaaactgagctaacttcaaagaagtatctggaattctcttcttcctccttaaccacttatagcccccttatccccagtcatcattgtagtatatctaattgttggtggatataatgtgggccactttggatttgagtagtcaaaatcagagcctggctagtaattgggtttgaaggagagttgagctgaagtcatctcatgaaacaaaaatggcaaaagaccatcctattaacactggacttcctttgtcttccttcataagatccctcaggctttccttagtattaaggagcagggggagaagacggtggcatatactgccctttaaatatggcatttctgaacttagctctccttgtactttatcaagtgagttgtcttcctctctcaactagatccaaagaaacatggcagcctctgcagtccccgtgaagtgctgtgagtgggatgccagcaataaaatcatgtctttctatggatttttggttggtgttctaaggcttgccgcttctcttcctaataagcctgcaccgattttgtccctgaagatttgaggctgtgaaatattcttccttcttcctgcctcctccagtctgggaagcttcacttatagccagagggctgagtgaggtacagctactcctacaatgaggcaagccttagtgttcttggcttgcttcactgtgtttctgacactgccttaccttaactcttgagtaagccccgtttcctgggcagaatctcacttctcctttcttgctggtcatttggctcttttttttctgacaagagctggatcttgcttgtttaccatctaccccagcaccttattcttttttcttggaagtgccaacatattcctctacgtgctgaacctgttcagtaattcttgttggattgtcattcctttggcaaactgaaatgaaacacacaaatctcaaaatagatgtaaccagactcctcaaacttaataaataccgtatgtgcttacactaggaatcttgcttgtcccgtttgttaacgggtacttcaccccactctcctgcctcctgcttcttccctcggcccctgtttcctacaaatcgaaggctgacagagcttttcccctgtgaatgctgctgactttaccagcagctcatcctgtgtagttacgctgcatcttttgatgccgtgcactcgtttggatagtatatgctgtttaaggaactgtctgtgcttgtattattttgtttgtggaggatgtaaatgatatagggttaattctgattgccatcttcatagtgagctcgctgtggactttatcagtatgtacacagcatatgcatgtgtgcacacaataggttttgccatggagtgcttctttcttccgagagcaggcctggtcaactgttgatgcaagcaacaacatttgtttattgagttcttaatctgccaggcactgtgctaagctatgtgtgttttagctcatttaattgtcaaaataacttggttaggtaggtactgttgtcatcatcaccccattttaggaggacctgaagcatggagttgttaagctacttgcaagtgatcagaagatctggattttcaagctgggcagttggcctccagagctcaggctcttacccatttctaaatcactgctcctaagttgctaaggcaaatgattgaaccaggaattggtttagcccctgaatgacaaagcatagagtagtcatggcttcagtgtagcactgatacctttatttgagggattctgaagaattctgactttattacagcccttgaggcctttgattaagaaactaattcccctgatacataatgagatttctctcttgtttcctcaaaagtgagtgtgtatagatctagggctgtgccgtccgatacaggaaccaccagcctttgaggttgtggagcacttgaaatgtggctagtgtaacctaggagcaaacagtttaagtttatttcagttcaattaatttacatttaaaaacacttcagttactggaaaactttttctgtatttggaacaacttgggtatgtgaacctgtttttttttcatttgtatattttatgaaatctaaacataagtgtatctgctgaaaatttagcatgtgaattacaatgtgctgtaagtaaaaatacacaagatttcaaaagcttattttgcattttttcccctacttcattaataattttatgttggttacatattgaaatgatataccttatttaagccagtatatccaaaacattattgaaatcagtttcttctttttactttttaatgtagctactagaaaatttaattccatatgtgcttctcattttaattcttttagacaatgctgttttagagcatagatgtgaatactcccctgtacaacaataccttactgaagcaagtgctcaaaagataattattgaataggtgatttgagggtgggagctggctagagaactcattcaatggggagagataatggaacctgattactttgttgaaattggtactttaggatataaatgaagtaataatgatgcataatagactccacataacatacacaatgctttatagccctttctgtaaattacctctttgactcacaacgtgataaaatgaaagtggagaaaattaacatgagccaattactcttgttcagattgagtttcctgtttctgccatgagctggaatacactgacgctgttgattcgtttttcttccttttgggtggattttgcaattaagcatatgaagccctccaggacaggcctcctcctggcttcttttgccttcttgtctgctgctcaccacttcccttgtcatctgagaacctttgcatacgtgtcatttcagctcttcctgatatcatgtgtaacaccgaggaggaagtcagtgcctctggaatcagaattaagtctctgcattgccttgggacaccccatgccttgagaagtgacacagctattgtcaacacctctcattatccacctacttctgactacttttctctagcctccttggctagtatcccttttcccacatgctccctaaatgtttgtttgcacccacagctgcacccgtcttctgactcatgccatttctttgttattctgcatgttgcctgagccttcctattcactctcaggacttctgctcccccttgcgtggcctgtccagtggttgtcaaattggggtggaaatgctgaacctcctgtgtccttatgctccgcttggagaggtcatcaattgaaaattctttgcttaattgagcatgcaattaagagtaaggaaatacatgttctgatctttttcttctgctatgttttctggttataatttttttaaaaagaaaataatgtctccgtcctttagttttcccaccttgtaaaatgggagcagtatgtgcatcctaaggctagtctgaagaagcattatgccgtcatagagaaacacagtaattctatggtgtgccgtatttggctgtatactgcattttagagtagttaactaccattggatttgaaatagtacatgaaactgaaacactgcatttattaatgagggtaatttattcctaggaaacctttttaaaaatgaatgtctcctttaagtgtttgttggtttcccctttcctgaccataccctccctgctttgtgtctgtgttatttcttttaaaatttcaaatagatttgaataacttagcttaaaagatagcctctcccctccctaataaaggacaaaggtggctattttagaggtgggtgatatttgaggctgaataatgcaatgtttacggcatacacaggaagtgggaagacctgggttctggttccatttctgccttttcaatcattttgtgagctgagcaagtcccgtaatctcaggtgatgtgtatgtcccttagcacagggcctgttctctagtaattgctcaataaatattaaccattattattggttgtcttctgagaatatcacttgaagatttagatgaaagtatttggaagattgctgtctacgatttgtcaaccgtggctgacaactaggacgtgggaaagtagagaagaagctgataaagatgaaaagctcatctatagaaagatattgaaaatttatttcttctagattacaaaatgacattagatattataccctatgagaaaaaatacgcttaatcaacccattttcctcttatggccataattagtacatagtcgcatcaataaagattgacaatatagccttctcatattgccacttctagatccacttgtaggcttaattttggatcatatgccggatttgaattgtattatggaatcacagagattgtcatggtgatatgcagttccaggaaggagtgaatcgtatgttctggttattacatgaatgagagacctaagagctcagttagccaatttaacatctagtcaaaggtactgtggctaagggattaaatatggttctcatttgaaagtgggagcagagcaggaactttgtagttgtgtgttcttttaataaaggctattaatttagttttttaaaaaagaattggcctcctaccaccagctaactgtcattgctgttcatttctgttagtatgaccaagccctgttctgtggaagtgttacagaatgtttggcttcacataagagacctccctttcatgtctaaagaggcaaggaatgtaattttaggttgtttggaagatctaattttcaaagctgtgtgatttaaagaaaaaaaaaaaaagcagaaaagtcccgtacgctgtcgtttgcttagtcttatctgaggtgcccttacattttgctctttgtaccgtttgaacagccaaggaatattagtttaactcctaggtaatttgggaccacgttttgtcttttggaaaatgcagttacaaatcagttttttacaaaacaaagtgaggctgttcagcccttcattttgatcctctgaggagtgaggctgtttagattgagcaagtaagatgtatttattcttgacaaagaaagccaaattatttaccagaaagctcttttagtttcctgtacctagcacttgactgcagggtgccttaaaaaagcaagggaccaaaaataagcaaaagaatgagctctcagtatagtccacgtgggggtgggcgtccggcgcctggttctgtagcagccccactccagaactggagccaacatttgtttccttgtggttacatttagaaacttttaaccttggcttctcacactccctgaactttataaataggaacctcttcatatactagatggcttggaggcctgttacgagttcgtttgaggttctggatgatggtgatgtttgggaaatggtgatgtttgctaataacactgccaagacttttctttggaaacggaagtccaccttggtgtgtttttttaacccagtgtttctcaggtgtagaagcataatgaaagcttttgaaaatttcaaattccaggctataccctgtactgcctggatcacagtttcagtagtgcgactccggtagcagtattttttaaagctcctcattccagcaataacccaacactaacagctgatcacatctgctctaatctgagactggattgtgcactagccataaggagctttctttcaaatgcaaaatgatggcataacagaagtgttcttattgtgatactataatcaaacagagtgatttcattgcttcgattaatatagtctttctacattataatagcacaggcttgatgaaccaagcatatcataattatcctttattgaaatagaaacctcccagcagtgtcctgaagggtctttaagtaccttgaggtagtaccttctaattaccattaataaaagatcaacaggttttagatatccaattagtgtgtacgaaattatcctggtcacttatgtctcagtttgtgcttttttgtgcaggtccacaaccctatgttaatatttttgattgaaaagcttcaaaaaagatttttttcttttaaaagaactcattttatttacaaagcctggccagacctgagctcacctggcagccaacctgacctcagctaaagggaagctacttacagtctttatcccagttgtgtttgagtacaaacatcctaatgctttgactatgggatactgccccagatatggctgccttaaggagtacaaggcgtatgcattatctttattacctttccaaattcccaaagaattgtgaattgcaaaagacatcaggctccaggcaattcagataagggactggtggacctgtgttgtcatcaggccaattccagggtctcatttgcaatcacatagttttcctgctcattccagccctctgccactgtgtgaccttgggcaagtaacttgacctttttgagcctaagtttcctgtctgtaaagtggtgcaaatgatgataatctgtcttaagggtattgtgaagattaagagaaataatgtgcacagagtgttttaaaaatagaagtttaaggaactcgtgaatacaagttcttcctttgggcactgtgatggcacatggtaaaccctgaaatataggttccttttagtaagtgagaggtccaccttgaattacagtgatacacagtaaagtgttgttttcaagctgtgggccaagattgggttttggaatctgtttattaggttgtgaccttgagatcattctatatggaaaagaaatacagtaatagaataaaaagtatttgtgcatttcatcaaagaaaggcaatctttttttcaatacttgcacatttgtatatgtatgatacatatctttttaagagttggggtctcactctgtctgccaggctggagtgcagtggtgccattgttcactgcagcctccaactcctgggctcaagccattctcccaccccagcctcccaagttgctgggattacacgcatgagttactgtacctggcttttatatgtttgttctgagtcatgatcctagtgttgtgggagagacaaacaaaaagaggttggagtagatttttattaataataacagaattattctgttcactctttccagggaatatagatctctgtttttcatggtccacttatttttagtgtactgagatggtctaatacacaagtaatactcacatggtgattgagataattgagaaaatcatggggctgatattagtcaaaagttccttttgcatatactgtccaaaaaatcaaggcccaagatttcatattgattcaaatgatctgaatagttgccttcactctttatttcatattgcatatgcagacccagtattgaaaagtcttcatagaaaatattgacaatacccttctgttaggacagtcttagcataagaaatatgtacaatgaatatcttggaccatggagtatttgtgtagtttatcacatttggaattttctgccccttggagtttgtttaatcgtaagtcaaatttatttatttacttacttagagtctcgctctgtcgcccaggctggagtgcagtgacgcaatcttggctcactgcaacctccacgtcccaggttcaaacaattttcctgcctcagccacctgagtagctaggattacaagagtgcaacaccacacccagctaatttttttgtatttttagtagagatagcgttttgctatattggccaggctggtctcaaactcctggcctcaagtgatctgcccgcctcagcctcccaagatgctgagattaagggcatgagccactgcacctggcccaaatttacttaaaaccaaactttttcttgtcccatctcacttgcttacccagtgttacctgctcatcctgttcctgtgacactgacatcaggaaagccactagctctgtgatttacagttgccttttgagtattggctgaagagaaattttacctctaaatgtaaagctttttaattaaatggaaaatgagcttcacttactttatataattaagatgcagtcagagctgggtgcagtggctcacgcctgtaatcccagcattttgggaggctgaggcatgtagatcacctgaagtcaggaattcaagaccagcctggccaacacagtgaaacctcatctctactaaaaatacaaaaaattagccaggcgtggtggcgcacgcctgtagtcccagctacttgggaggctgaggcatgagaattgcttgaacccaggaggtagagtttgcagtgagctgagattgtaccactgcactccagcctgggtgatggagcaagactctgtctaaaaaaaaaacaaaaaacaaaaaacagatgcagtcagcacttatttcacgtacctgtttagactgtgcttagttgccaatgattgataggcattagttgggtctgaatggacctatggagccatggagcttttatttaacaattctttatctgatgtctgggaagcagaggagaacagagtcacagagccgtttaaaggcataatgttgtcttatttttatcactaagttgattgcaaggtttttgtctttttggaggctatacaacatagtgactggaataaaaacttcagttgcacccctatagcttgctctccaaggtctaagtgactgtgggcaagtcatttcgtcttccaaaacctgtttgcttatctataaaggaggaaaatgtgggtacagaactcaccttgaagaattatgcaaaaaataagtgaagtatgtgtaaaaccattattggaaactggtaactgctattcaaatataaaaatgaatggtgatagaatactggaaaatttctgagaataggatctgtatctagtttatctttggacccataaaaatatagctaacatgctttgtagcagttcattaaattctggaagttagtttgcctgtggatgactgaaagctgttagttttatttccctttttgatatttagatgtgaatatggagaggatggagatagatgtccaacctcttagaccaagttcttgacacagaatatgggactcatcacggttaatagtaatgtattgtatatttcaaaattgctaaaagaatagttttttttggtttcattttgttttttgttttgttttgttttgtttgagacagagtcttgctctgtcatccaggctggagtacggtagtgtgatctcggctcactgcaacctccacctcccaggttcccgccattctcctgtctcagcttcccgagtcgctgggattgcaggtgcacaccaccacactggctactttttttatttttaatttagtagagatggggttttgccatgttggccaggctggtgttgaacacctgacctcaagtgatcttcctgcctcagcctcccaaagtgctggggttacaggcatgagccaccgcgcctggccaagaatagatttttaacattcttactacaaaaaaaaggcaagttggtgaggtgatgaatttgttaatttgccttatttaatctttctacagtgtatacatagatctaaaatgacattgtaccccataaatagacacaatgattgtcagtttaaaaataggaaaattctgctccatcatagatttagcactttgagcaattatgtttctagtgagtccaggtatccctgagtagggtggtatggttttagggtgagggtgccccttgatgcacttcaccttctcctcttttatgaatacaatgactattcatttcaaaattcctgtctcagatggtatcctgaggagccttggatgatgtcagcagtgtggcttcctttcagagagtctggttggcatcaaaatgcaccaagattgcactattctaggaatggctttaaaacaccagctctgtttaccatttgatgatatatttgtattacttaaagcaccagctatgtttactatttgattatatgctttaaccatttatgtttggtttctatttattgttcagtaaaggaaaagctagtagtaccaacattttgtagaaggctgggcatagtggctcactcctgtaatcccagcattttgggaggccaaggtaggaggatctcttgagcccaagagtgtgagaccagtctaggcttcatagcgagaccctgtctctatttaaaaaatgaaaaaattagtcgggcatggtgacgcttgcctgttgtcccagctagtcaggaggctgaagggggaagatcagttgagcctgggaggatcatttgaaccctggaggttgaggctgcagtgagcagtgattataccattacactccagcctggatgacagaaggagaccctgtcttaaaaaaaaaaaagaaaaaattgtagatgagagatagtttggcagtcctcatgagaaccccccatagtgggcggaacaccttgtgtaaacttggtattgtttctagggtttaaaaaatattaataattattatactaattctcagattatattatattaatttctcagatgtgcagttctcaaatctgagaaatagctcataggaagagttctaagctgtgaggttgagtccattttctgattcatttgggggcagaaattcctatctgggaagttagaatgatcatttgtgtaagatcttatttatcgtctcaagcttcaaagcaggattataagcacttggttttcaatgcatgaaaatgcccttggttagaaataaacaaaaagtatgggaatcttaactttactgaaaagatagggcaagtagcttggaacctccctatttggaaagcttaccatagagatctagcacaattaagcaaaaagttagtttccatgaggattaccaagaattatagtgcagtaagccacagcagacagctagctgctgaaatctataaaaacttatttagagacgagcttactcatcattagccttcacttttggagctagagtttttattagttaatttcattagtaaaggaatactcctacaaactggggaagtctcaggtgctcagattcttcatctataaaatgaggatgttggaaataaatgacttttgaaaaatcttccaaaaaaccccacagtgtctagattttggtgctgttttacccccatcccaaacttgtttcttcttccttgatttcctgtcagctctgattgctgtagatcctggatgatgacaaattggtgtctcagagtaaggagcaaacaagacaggagcctcaagcaggctgtccgttgatttgttgtttgggtttttggtctatttgcagcttctcaggtcctagccaatacaaataggtgaggttcttatataattttacactggcaaattagaacaaaacaaaacagtggagggaagcgggagatggacattgagtataggttggacaataacgatagaaaagtggtttggattctttataattatggtctgacatggttccagtaaaggtgtctttggttaaattaggtaatacgtggtgtatatatatacacacaaactatagacacatgaacatagcagctgctaaatttaatgccccagcgttgcttcatactacatgtagattttaatgagtcagcacagcctgctaaaccaagcttctggcaccgagagcctttttaaaactcatctaaacactattattgatcattcacaagtggtggttaaatttttttttaaatagcagaatctttgttacccaaattaaaagttacacagaaccacagtatataaaatagttaaaagccaaacactgccttgttcctgggctccctggggcctccaggggactttgagaactttggttacattgtttgaaaaattctgactaaaatgtatatacttaatatacgtatacatatatacatatatatatatatatatatattttttttttttttttttgagacagagtcttactgtgtcgcccaggctggagtacagtggcatgatcttggctcactcccgggttcaagtgattctcctgcgtcagcctcctaagtagctgggattacaggcacgcgccaacgtgcccagctaatttttgtatttttagtagagacggggttttaccatgttggtcaggctggtctcaaactcctgacctcgtgatctgctggccttggcctcccaaagtgctgggattataggtgtgagctactgtgcccggcctgaaaatttttttagttattgttacaaaaaggcaaagtgtaccaaataacaaaattgcaaaacaccattcaggtattatggtggtgatctgattgtgtttttattttagtaggaagcagttctatacattgaaaatcatttgtgtttaatgttgagtggtgtagaaaatgttcataatataaagactaatgtaggatgagagctaaatttcaggaaggttcagtgagtataaattcactgaaaaaagtatttaaaagtattataaagacaaagatgagttttactaaaaagcttatatggatgaaattaagtagaataaagatgaaactttgtgacctggtgaatttcaaataagtatattaaaactacagtatatgcttgattataaggcaactctcaaatgaggtgatgtcccacattctcaagaagaataacaaataagttctgaatgtataaacttcttgggatataggtgaaataattgaaagtatgttaatatttagttacacatataaaatatgagataaattttagaaaaccttcattttcccactccaagttttcaagaaacagtttttttttgttgttgttggtttgttttgttttgagacggtgtctcactctgttgcccaggctcgagttcactgatgtgatcatggctcactgcagcctcgaactcctgggctcaaccaatcctcctgcctcagccaatcctcctgcctcagcttcctgagtaactggaactacaggcatgcaccaccacacctggctaattaaaaacaagtttttaggagggatgaggtatcaccatgttgcctaggctggtcctgaattcctgggctcaagtcatcctcctgcgttggcctcctaaagttctgggattacaggagtgagccactgcttccggccaagtgaagcagttttatttaaatcctacatgtgcttcaacattacttcatcaccagaaccactttttggctccttctatagtttgagtatgtcatctttatttctaagtctgtatgatatcaattttgcattagcacctcgactttgatgtttttacattctaaattatctacatgatgtaaaaaataattacttggaaagaaaaagcttaagtacattggctttaaaatatatataactgggagattgatggattcatggatgttgtgggttgtttttttttttttttttttttttactctgtcatccaggctggagtgcagtgtcgcgatctcggctcactgcaacctccgcctccagggttcaagcgattctcttgcctcagcctcccgagtagctggcactacaggcacgtgccaccgcacctggttaattttttgtctttttttttggtagagatggggttttttggccatgtgacttacgttgcatgggagtgtatgtcctgctttacaggtattggccttggcctataactcgttcggcggaagaacataaatgaatgtgatgcaagcatatacttaaatgggatgccttaaatgtaattgggattttgtgctaatgtgagtatcatgagaaactatgccccagctacctgctacctcttcagcctggacaccagaatgacgtaggtggtgtagcagacctgattcttagccttagcaggcaggctgaagatctctaggatacatcacacagcaactacctgttggtctatcagatctaatttgaccactacaactcacaaatctaataataatcttgcatttttttgtctgaattagcagaaccagaagttacacttaagataggttaggtaatttctaaattaaaaataactctgggccaagcgcagtggctcacgcctgtaatcccagcactttgggaggccgaggcggatggatcacctgcggtcggagtccagaaccagcctggccgacatgatggaatgaaaccccgtctctactaaaactacaaaaactagcagggcggagtggcaggtgcctgtaatcctagatacttgggaggctgagacaggagaattgcttgaacctgggaggcggaggttgcagggagccgagatcatgtcattgcactccagcctgggcgacagagcaagactctgtctaaaaaaaaaaaaaaaaaaaaaaaaaaaagtgaaaatcagcctcaaaacaaacaaacaaaacaaaaaaaactttggggataatgcccatctaccaagggctatgcagtaacttgggattcttggcagtaggcattttcaagaatacagtatacatggaaaccagatgcatgcagtaaaaaatgtatcaccagccttgagtgcactgttcatttttccagtgagaccttcaaagggtctgtgaaatgaagcctggtgttttcctcttcaaggactcatttttgagtacactaagaacaaaattttggcctctctgttaggcataatttcagagtctctctctacacattcattggattttgcaagatatgtctgtatatatacacaagtggctcccatcttagtctgcagatttgaagcatatgtatgtgcttgtgcatagtcattctgcctctgcgcatgtttcactaaatttattgcatggactcttttatggctctctaaaggaaagtaaacacttaactgaacaaaaagttcagctttacattttaaaaaatttcttctaagcagaagagtttgagataaaacatgtctagtgacgcctccatttatctactgcttacctagtttactcgccaaaatagatcatttaattgaaactatccagtttgtgtgatgtcttcctaaaatacacttaactgattgaagtttgacccacccgttcattattatccattttcattcaaataattaacttgattatgacttcgatatagcactttcaacagccaaaaaacaacgttttggcctttttagtacttttctaccctggtatttcacgtgagactcacgtggggagctttaaaaaatagtgctgcccaggcttttcccccaagattctgatttaatttgtttggggtggagcccaggcactggtagttttttaaagcctcccaggtgagtctaacttgtagtcagaattgacagccacagctacagctacagctacagcgtttttgtaaactttattattgaaactaagcaattcaggttgaaatttgttttacgtgtaggattgtcgtgataggtcctctccagtgttcagatcaacctgataatgtcagatcttctaggaaattggtgtcatgtttgcagcgttatttatctcctattttcaacgtactttggggccattcttggaaggctgatcgggaaaattagttgcataaataaaaccttaatgctagcctggggataactaccttcctttatgactccagctatttaggtagtactcaaagttgcctcttaaatcacactgcctcagtcaactttatggaaatggatttaaatagtggtgaactttcctccgtcatggagaggagcccagtggatttgctctggtgacctcagtcacactcagcacagtagagccttgttagggacccaggaggcagcagtcttacctttctctgccagatgactatgtaaatagtcaatgacaggtcgctataaaagtttcaaattcctaaatgaaaaccaagttttccaaggaagaaatacaaagccttagcatgtgtacttaaattaaaaaatacttaagtctactggaactgtgtatttttttctaccacatgaatcttttttagaagaggggattttctttctcccctagccagtaaatatttatcttttggatatatagaccagctgcatatactgcatggattcctttccattcatatgtgaaatagcacatttttttccactagccagcaagactcatactagtatattactcataataggatgcattgagtctttttgattcattcttgctcttctaggatcctcatcagcttccatggaagtttacgatcagtttcttaagactggctgcgatgggttttgcgtgtgaggcagtgtgcttaaggttctagactcaaactttttggatttgaattctggcttttccacttaataactgaaggacttagtttttaaaagacttctctaaaccatattttctccatctacaaaatgggaataatcattgctacctatctcatagggcagtagtgagactcaaatgaggtctttcaagcctttgaaacagtttctggcattctgtaaatgttagctgctgctgctacctacccttctaattactggtgtaactgcctgatactgtccccggtattactctttgacataattataaaacatcaagtaaacacaggttactggtgaattaagaaaaaggatcaacttttttttcctaggcctcttgtaggcagtctctcctggggtcttctgtttcatgagtcagaggcttatctctctgtgattacaggctcactgggggcaggcacctattttattttacctagataaataaataaatccaatcccttcccatgtaaaatttttgtgtatcagctgtattgaatacttgtgtctattaatatgaatcttatgaatagtcttattgctgtaagaattccataaagactggacattgtttttcatggtattttgactctttaaaaaaacacacacgcaaacagaaacatggtggagtggctgaaaattggaagcttaaatttccaagttcatgtctgtgtcactgtagaccctgactggaaagtcatcatttccttgaacctagaggaatgtgctgaaacagtagtaggtgttggttaaaattagaaccaactatttccataaccagaattacagacacattaaaaaaaaaaataaagtgacagaaatctactagtttttccttgtgtattcaagaggtttttgacccagttcagctaactacaattggattctgtccctggacttggcacataacaatgcatggtagactttctagacctggcgatggaaactcggaactcttcccaggtatgagcccttaaaaaaatgtcatcaggatctgaacagcaaatgacagtgacttctcatgttgtctcctttgtgccctccttccctgatgctaagccccaggaaaagattccatgttgacattatttgtgtttaatagctcattactgtgtccacgctctccagctttcctttactagcagtgagcctgccaaggcgccagcactgcaactacacatgtttctagactactgtatgaattgctcatctcttgaagctatttatttgtagctaatagctagcatttgttacctcttgagaaccagagaaatgcacacacagtttccatggagagggggaaaaaaacccaaacaacctatgatccaggatcctgtttttgtctaaggaatgcagtttgcttgagcaagactcttaagatgtatttgtatagggtgcagatgttagtcattagtgcttaatgtatgctgagatgggaccagctaatggaccctctacactggtcagtggtgttgaatcaagctattgctggaaggtcctgaggaagtagtttccaacggtaatggccctgatccctttgcatatcgtttcttttggcctttcctccctcccatgctgaattataacagagtcactggtgtgcaattccagaatgtctcagttttttcatcagatacctaacatttacaaaattactttaaatatttgcctcagtccaaggtcttgggactcagcaccttttttcttgcttacataatttaaaaagtctatggtgccattttctcaatgaacaggactagtttaaaagagagatattgggccaagtgcaatagctttgcctgtaattccagcactttgggaggctgaggtaggaggatcacttgaggccatgagtttgagagcagcctggccaatacagcaagactgtgtctcttgaaaaaaaaaaaatagctggaagtggtggtgcctacccaaagttctagctacacaggaggctgaggcagaagtattcagttgagcccaggagtttgagaccatcctgggcagcatgagacctcatctctataaaaaacttaaaaaattagccgagcatggtgggtagtcccagctactcaggaggctgagatgggaggatcacttgaacccaggagtttgagattacagtgagccatgatggtgcccctgcactccagcctgggtgacagagtgagaccctgtctctaaaacataaaatgaaaagagagctatcaatggctttaggatttgggctgtaaacagtgatacagaagagatgaactttgcgaaagaataaaagatgctcttagggattggggagtgtctggtgcattaatggttcctgtcttgggaaaaagctgtgtgtagcaatgttcttgggtgttcacagtagctcttgtatatgagacgtggtcattttcaaggttgttcaccagtggtagaagaatagatggcatttgatgcttgttattttatacttttaacttttaaaattattctgtaatttaaaaatattctggggctgggcatggtggctcccagcactttgggagtccaaggtgggaggattgcatgagcttagaagtttgagatcattctgggcaacacagtgagacctgatgtctacaaaataatgttaaaaattagccatgcatggccgggcacggtggctcacgcctgtaatcccagcactttgggaggccaaggcgggcagatcacgaggtcaagagatcaagaccatcctggccaacatgatgaaaccccgtctctactaaaaatacaaaaattagccaggcatggtggtgtgcacctgtagtcccagctacttggaaggctgaggcaggagaatcgcttgaacctggtggtgcacacctgtggtcccagctactcgggaggctgaagtgggaggatcgcttgagcccaggaggttgagccgtgattgtgccactgcactccagcctgggggacagagtaagactctctgcctgtcatagatagatagatagatatagttttcaacctctaactggttttgtgtgtgtgtgtgttgacaatttatctgatggttctttgaaaactgaaaatgtgtccttcattccaacattatacatttaaaaaatcgaatgttttaacataaatatgggaggagtactccatgaaggtgaaagccagtgattctccttgaagaagggtattgttctgtgctagcggcatctccatttcgcctagcaattgtagcagaatagagactgcatcccctctcattctacaggtaaagaatagtttgaagagaaagcttagtgatttcactgccaaaagaaagcttttaacaaaattgcttattaaaccacacctcaggctgtgcagggacatgggaggagcgtgcaatttctgaaaaagaatatttagaggaggattttattgtataattggcaaacttctcatctccgagaataattgcttgatttcatggaaaggaccagaacttgggtatcttgaggcctaagataaatagatagcaacggatcatgctagtccccatggttactgggaactgagctcaagtggattgttatcctgaacaagtctgtgtcaggatattcttgtcacctttcagctctttggtatttgctctctttcttgaatcagcaaaagaaatcgctgtaaagttaatgtaatttacgggaagttcccgtgccacactgcatgcttttgtgtgtcacaagacttaagcttcctgctaccctctgttaaaggagaactttttatgttcctaacaatatacgattctttcaggagctatttacatagctgggttggttaatagacaactggggactgggctataagcattttgacctggaaatatttctttggggttatgtgaactactgtacaataaaacctcaattaactaggattacttggagaaaagacagtttctggttgaattttcttttaaatggaaggttaaacactttccttttctcaacccttcttattcactttcttcctttggcttttggaattcagatgttaagatcttgaaaataagttaatgtttcattgagttagtccgtaacagtgctttggaacatccttgagttatgaagcttgttattcaggctttactttcttcagaggattaagaggcttgaacgtggctgctaagttctctaagttgttttctggggggaagaataaatttttctgtgtaattttgttttcttgtatctttatcagattcagaataaaaaagctatcgtaacatgccctgcatcagtaggccttgttagttacgtaatcctactatttgagggtttaggaatattctagcaaaatataacagaaatgagccgttagtaaattgcttaacttaaaatatttagttttcttctgtgtgtgttaaagtcaagttatattaatttaataggcagttgggttggctcttttgcataatccagacaatatatggatcccacaaatatttattgagtatatactctgtgttcttcatataccatgttaggcagttttgtaatatcagtaatgagaccagcataagtgtattaacctctgataaccttcacataaatcttatattctacagcaatgaaaacttgtccctaagggactttgtggtcacagcagttctgatttccttgtttgaaatttttgtaaactttccaacttctttgttttgcactcagtacttaaaaataaatttaatgccagaagtaaaagtactattattttcatcaatcataagttatagataacaaaaactcagaaatttttcttgaacataggtagggaacttaggtgaaaggactgctttaattccatctaaaagataaaacctaatactgacttacaaatatgttgctaagagtttagtgtctccaagtaaaggtagaaattttacattatctatcaatgatatcggcgaaaactaaaattattaggaagtaagctaagaataatttatagtctagatttttaacttaaaagtggaaccaatttccaatggtttcttcccttagttcttgagttagccatactgtgaccattaaaaaacatctttaaaatgtatgtgaaaaaacctgaagaaaatgtggcaaagggtaagatttgataagaaatgggtctaggtttatagggaatgcattatagtctttatagttatgtgtgtttgaaatataataaaacacttttagatgaattctttcttttttttttttttcctttttgagacacagtctcactctgttgcccaggctggagtgcagtggtgtgatcttggctcactgcaacctccatctcctgggttcaagtgatgcatgtgcctcagcctctggagtagctgggattacaggcgcacaccaccacaccagctaatttttgtatttttagtaggagacggggtttcaccatggctggtgttgaactcctgacctcaagtgatacgcccacctcggcctctcaaagtgctgggattacaggtgtgagccacaacgcctggctagatgaattatttcctttagaaattattttctgtgtatctgcaaaagtgtttcattttagtactgtgaaatgaataggccctatgctgggtcctgttggggtttgtgatttatagatggtaaaatacatttcacacttacaagatgaagcaatctacctctatataaagagcttgcctgtgggtggttgtagcaagtgtcttcttattatttcacaattgagggcaagagagaggtcagaccattggtgaaacccttagtgcaagcaagtccgcaaataagctttttagctacttaagcctaggtgttttattggcattgaaggccaagacacacgagcaatacttgcacaatcaaaagttctatttttccaagacatgctggtcacacaagaaaaactgagataacatataatttatttttccaagacatgctgatcacaaaagaaaaactgagataacgtataatttagttactgtgtatccactttggatccagattgcatatctatatctgtctgtaaacagacatatgcacacatatatatacctgtgtgtatgtatatatgcacacacacacatatatatttaaaatcacagtacttaattaatttgcctccaaaactaatggccacattaatgcctttgagctaagttagactggctggaatcagttggcaagatcctggtaaatggttttggtgtcaactaggacacaagccaggtgtggtggctcatgcctataatccttgcactttgggaggctgaggcgggaggatcacttgaggctaggagtttgagaccagtctgtgcaacatagactccatctacaaaaaataaaaaattagccaggtgtggtagcatgtgcctacagtcctagctatttgggaggctgaggcaggaggataccttgagcccaggaggttgaggctgcagtgagccacgatggtaccactgcactccagcctgagcaacagcgagaccctgtccagcagggtagagtgcaaaggatgcctgtggaatgggagaatctgttcagcatccatcctcctgcttccaggctaaacccatgagaagagtgctgtcaacaaaagaagtgttccctacagtggggaagaattgaggttagcagaaagggtaaaacaagaacaaagtaattcctagccatccgaagaggtggaatgggaaaggcaacacctataacaggaaggaaatactccatctggggctgagcctgtcttattctgaggcccaagcttggctgcctttctcttcattccctctgtgtgccacttaacagtatgcatttcaactttcttttcagggaggggccagatgtagaaatgcctcacactacagtggaggagacctcaccagctacctgtaccagtaagatgggattagctcaggaaacgttgttgtttgtttgagggacaagaataacatgaaagaaggagcaagattaacagaacagctgacctagagctgctaggcactggatggtcctctgtgcttatatacacaatgtaatacttgtaaggaaaaagcaaaaggcttggaggaggctgtggactacctatagttgacagtattttcctttgtgggggtggtggatgtgggacgtagaatgtaaacttcctaccttatacattgatgttacttcattgattatagtgaacactttatagactgaaacaagtctaagaaaaattcatcttgagctgaggagatagagatgacctgccaaagatttcacatccacaaagtttgtatgactgatagttttaataaaaaaaatttgtcagccaaaacatactgagagtttcttagtcgtattaactgatctgaaactgttgccactaggggatataaaagatactacctgtattttagtgataaaccacaaagaataaaatgagtttttaattagcatcatgcagccacttaagtattagcaaagaaaatttgtagctgatctttcagttctctgtaatatagaaaaacagatgctgcatctctagttttgcctgtgcctgggggatatttaaaacttgtactaaaatgttaatttcgccatggtagaggtgacggggaaacttgcaaaaaaaggggaaagaggagggaattgggtgcatagaagtgagcatgaggccagcagtagggaatgagtttacaataaataaggtgtgagagtggttggggggagtgggagaggtttgggggctgggaagacaagggaaaagaaaatgcagggatatgctatttgtgttcattttgtctttgaaaatcgtaagtgtacagcatcattctcgggcagagtctgggaggacttgagttgactgctacagtttatgatcttccctaaacatcgacgttcctggaaatctttggcctctgagctgacttcttctctgttgcttgtgagccaggaatttaacagctctgttgtatgtgcaggctgcagatgcttctcttcagcttttgctatccaatgtgtgtgtgtgtgtgtgtgtgtgtgtgtgtgtgtgtgtgtgtgtgttggataaacttaaaaaacctgttgcttccatgcaacggcccacacaacttgggactcatggtcagcctcaccttccacattggctaaaactctacaggaaacagtttatggagtttaaggaaaaaaaaaaaaaaggaaaattatcagactccaagcaagttatttatggaccagtgtgtgaacagaacatctgattgaaaaaagaaaaaattacagatgggtggggatggaaaggcaaatgtgttgtgtagctggccaagtaatatctggttgtgtcaaaaaacgggaaaaaacatcatcttcaatgagttacgttatttgtattccttccatcttgcctgccatgtgccttggataatgctgctgtctattaagccctctgtgtcctactccctcgccagctttgctccattgtgctgttggtggggacacagcccaggtggttgggtgatgcctgtgctttcctcctgccctcttttggtgttgctatttgaaaatcacttgtataatgaatgtatcctctccccactcccattgttatgtgaaaaaagccagtaaaaatgaacatctggcaaagaaactgtcccaatttaaggaggaagtttgctagatttatgatcttcctttgtaactcaagtataaactggccactatctgaggagtgaggtcttgctacacagttttcagggtcagggggccaggcaggggtcgggtagggtgagtggaagctctggggttgccgcctaggctggaaaaacactgtgcatcagctgaatggctgccggcctgccaggatgctgctattttctatcctgattcagttttgtgaaaggacagtgggtgtgaattgttggctgggtctctggatcactaaccagaaataagcttagctaaattgaccacaagaaatttcactgttttaaatcccaccagccaactccccaaattttgccttttttgtctctttccttgaaattagtttaacattgcatagtgtattttatcttcataatgactacttaaagatggttttaaaactgaactatagatcagccagggtgtgatggctcatgcctttaatcccagcattttgggaggctgaggcgagaggatcacttaaggtcaggagtttgaggccagcctggccaacatggtgaaacctcatctctactaaaaatacaaaaattagcctggcgtggtggcgtgcacctggaatcccagctactcggggggttgaggcaggagaatcgcctgaactcgggaggcggaggttgcagtaagctgagattgtgctactgcactccagcctgggcgacagagtgagacttcatctcaacaacaacaacaacaacaaactatatattgtaaaatagagttatactgagctaaagtatacattttaatcatttatgtactatgaaaaatagtaaattgcttttgtaaaaataaaaagtactggcatgaacacagcattgttccagtggaaggagtttgtgggtttcagaagtttattaccctctgatttagatatggtcctgtctgttgaactcacggtcatggtataatgacatctcttcattccgtcccccaccctctgcccccagaacaattaccttgctttatgtaatttcttgttagatcagtctctatctccaaaagcaactggaatagattaaatcaaggctcatacacagcctataaaaacaggaacttcatttcggggaagatttttgtaagatcgttttctaaaatagcatagtatcagaaatatttctgtaatgcttttcggcaaggaaattagttcaatatttttggctttgtcaactcagttctcaataatagctgtactctgttgtcattacagttttggcttttctcaactggagaatgattttatattaagtgctttgtaattatttttttcttgcatttttatctaaggctttgtaaggggggtgttcaagtacagcgtggaaccagattcttcttttccttatctttcataattttccatgtttgttttgaattaattagttttgattcaaacaaaaaaactagcattttaaaagatctggtgtttcagtattttgttttgtttaatcaccccttgtttcttttgacactaaatttttctcaggaactaagcagatcggttatcgttcctctactttgctttattgaactccctaagtgaaatttgttttaacaaagaggcagtgtttatgtgttggtgataaaaagaaaatagccgatatattattactttttttttcttctatgtcaccttgttatgtaaggttatttcattacctttgtagtgtttttcatggaaaccgtcaacaaggaagtacctaacactgcccaacatgaagccaaccataattgtggatagaaatagtagactcctacttcctagccttaaagaatgtataatttagttagcaagtgaaatcccaaggggtacatcataaagcaatgaatgattcaaattggcactgtaagaataagttctaggtggtatggggcagcctataagagctattggaatttaaagaagcaagagattcttatgcaattatggaaaatgttctcgaggtagaggaatttgagagttcaaattgttttctcatcaaacttctcctcattttagattcagcatttgataggtaggcttccagtgtaatttcttttttcctgttaacaaaatgaacctcagaattctgaaaaggaaagatactgattcattcaaatctcaaatgtcctaactttatagaagaatgtggtactatggaagggcacaaatcaaggtgctgttaatatgagcggtgttgtagtttggatatttaaccctctaaacctcatgttgaaatgtgatccccaatgttgggaggtggagcctagtgggaggtgatttgggtgatgggggtggatccttcatgaatggcttggtgtcctaatgagtcttcctggtgttatcactggtggtaatgagtgagttctagccctattagttcatgcaaaatatgtttgttaaaagagcctggcacctctgttgccacgtgatctctgcacacagcagttcctcttccccttctgccataagtggaagcagcctgaggctctcaccaggagcagatgctggcacaatgctttgtgtacagcccagagaaccatgagccaaataaaccttttctttagaaattacgcagccttgggtatccctttatagcaacacaaatggactaagacaaatagtcacctttaatttgggtttgtaggatagccagtgtttaggaccctgtaattttgcttttaaaaccatgaaagctcatttcagatattaacaaagcatttggcttacatatcttatttgcttggtgtgtacacaggctggattaaaaacaaaagcaaatacagtttggaagaaaataaagccagcagcatcccctggtgaatccctttaaccatccaccccaggaatgtctgcagtgctggttagggcagagtggggcagttcctctggaagacggtatgataaacgagggtcacccaactgtgaggccagaggaagggagactatcttcaggaagctgtgagcttttccttttgtatggagagtgttttgttggactaaagttgtagaaggcatttgacctctgttattgtatttagtgtttcaacctcagcatctgacccaaaataacacatatcttttcagtaacttgggacagagctgacaaaaggcagtcaaattcagaaggagtctcattgtaaaagaaggattataaactacacaaagagcaaaattagtagggaaactaccaccacaataataatgctgcagtgttttcagagctgatatgtgattgtgtttttcctgtcttgattgtttttaagtttggtctgaaaaatacgggtatcaaattaaaatttcataaactgctacgagtttctctccttccagagagaaaggatattcatttgatttgagaattgtcgttttggtttaattaacagttgtttgaaggatgttaaaaatcatcgtggtgaattggtttttatcctaacaattgcatgataattttagattactcttgaaatatgcctcaaaataaaaagttagatgtagtggtcctttctcatgtgccttgactattgtcagagaaagccctgggttatcagcctgtttagaagaagtgacctggtacgctttttgactcttggctctgaaatcttatcatcaggaggaccatgtggattttattcatttgacagatacttactgtgcacctattatgtgccaggccctgttatgcagaggacaagtagagtagaaaatagaactactaacacttgcaacacacacagtcaactcttttgttatagctcagtttaattaacagaaggaaaaactttgcgttggggaatacacataacacctggaaacgcagcgttggaacacccgatttgtctatgatgcttgcttactactcctattattctatatattacaaagcctgaatatgtaaatggcagttcaatggtcttttaggaaaaaaatttactggaaatatactaacaggaataacactaaggaattcaggagctacaagaattcttggagttctgttatttcaggtactttctttgaagtattaagtacatattatcagtaagttttgttgtgttcctattctacgtagatcatattatcagatagaatgtaaagatagattaagatgttcatgctgggccaagtgtggtgactcatgcctgtaatcccagcactttgggaggttgagatgggcggatcacttgaggtcaggagttcgaaaccagcctggccaacatggcaaaacaccgtctgtaataaaaatataaaaattagctgggtgtggtggcacattactataatcccagctacttgggaggctgaggcacgaaaatccgttgaaccctgggaggcagaggttgcaatgagccgagatcgtgccattgcacaccagcctaggtgacagagtgagactccgtctcaccaaaaaaaaaaaaaagatttttttcatgccctaaaagcttttacacctcctagttgagaggacaggatacacatacacacacacttccctacctgcctgcctgcctccaggaagcatatacgaaatgccaatcaactaggatgccttgtttagtgttaagaactagagaatgacgtggatagctgttctgattctacgttagtatttcttagcttctttcttaccctagtcatttcactattaggttggcaatagtaattccccatgtttaccccagcattaagcttgtgtatcttctatcagcccataccttataggtggcaagattaattttaaaagaatttcagacttaaaaaaagttgcaaactagtacaaggagtactagttgctatataatctttcttactttccccaaataatgtctcacataatcatagtgtgatgatcaaaactaggaaattaacagggacacaatactattaatcattgtcctgctgatgcccttttctgggtccgggatctagggccggttcctacattgcatttagttgttatgtctctccagtttcttctaatttggaacagtcagtctgtctttgttctttatgattttgataattttggggattactgaccagttatttcatagactttgattcaggctgggcatttttggcaagaatatcgtggaagtgatcttgtgtacatattagtgcattatcatcacatgcccatggtatctgcatgtctcgttactttgctaacttgatcacttggttaaggtggggcctgccagatgtctccacagtaaagctatgatttttctctttgtaattagtgtcttgtggggagatactttgcaactctgcaaatatcttgtttcacatcctacatttgctaattaattttagcgtttgttgatttcctggctgcatcaattatcactgtggtgtttgccaaatagtgatttttaaatttctgtcatcccgtcatatgagttagaattctgtgagggtgagctattccttctcctcttattatttattcagttatttatatctgtatggattcatggatatttggttatgggttacaatctcttcctatgattatttattatattgctcaaattgttccagatttggctattgtgaggtccttaaatttggcttgtaatgttcttttgacatgttccaatttttggaccaatttcttacttttggtaccataagatgttccaagcttatcttggatttttttttttcttttcctgctccagccctggaatcagtcatttttctaagaagctctagttcgccttattagagaaaggtatatagaaaccaaaatttggtgctagatgtgcttattgttcctaagatgtcagtacttctagccgttctcaacagatagagctaggaagtatatgtgtatacatatacatatgcacacgtttgtatctatatattaaaaaccttagggttcattctcactttcccccttatatgtaactcttttatctgaatgtgagaaacctggttgtcattatccacaatgtgtttacttatttgtgcaattctaagctacacacatagtagttttcagaatgctaacacataccccacgagaaatttgctaactagaatgtaacatttgtgtgcatttttttttgtttttagtgttagaatagagtactgttttctaaagttatttaggttcttctctacctactttgtgcttttgttcatttgtaatacattaggttctcttatttcattttgattaaaatcatgttggttttatttatttttaggtgatgtcaaatattgtcacagttctaagacttataaatacatgaaaagtatgctcagaaggtgtcatttcttcctcattctttctgactcattcctgtcctctttctgtagataatctcattacttcttggtttatccttcctgtatatatattttttacacacatcagcagatgcatactgtattttcttatttcctttttttatacttgaaaggtggtattttttgttgttgcacaaaaattgccacaaacttagtggcttaaaacaacacaaatgtattagctcatagtttctgtgggtcaggagtttggacatgggttagtcgggttttctgcttttctgctcagactcaccaggctgaaattcaggtgttggccagggtttcgatatcatctgaggcttgggagtccttttccaagctaactggttgttggcagaattccattgcttgcggtggttgcactgaagcccttatctccaagaagctgcccacatgacctctccctggtttgtctcttagtagtggctctgctgctttggatttttctaatattttctctagccctagactatctttaaagggtatacttcttaaggtcagacccacccaggataatcccctttcacctttgccatataatgtaacctaatcatgggagtgaagtcatgtcatactcataacctatctacagttaggaggagatgataatatatgacatgtgccccagaaagcaggaatcttggaggctatcttaaaattcaccttttaccatgtagcatactataggtagaattgcaagatagcctccaagtgcaaaaatttgaaaaagtattgttatattgtctatgctttttctccatgagatgtagagtttttgttcaatttattaaaaatactaattttggcagttagggtttgaatttctgttctagtgttatgtttgtattttaccattttttttaaaaaaatgcccacagccacaggtttcttatttaactttatattatctgggttgtcagtttttaaggatattcttgaacccttacctatttcctgtacaccaatccatgaactcagtcaaatttccagttttactcttccttcttctatttgtttaagtcgtattacttctatgttgtcacaacatataatattgtcacattgttctttcagctctgcatttcgatcttctggcagattttactgacgataatgtttttgtgtaacatatattgttgctgtcttatatcaggaatctctctaccaccaccctttttctttaaaaccttgagaatactgagatttgggagatcatcaaggaaaataaaactgaagacaaacaaatgtacttacctgaatgttcagagacctcaccattcatgtgcattattgaaaacatggcaaatggttcctacttcagaaagaggcagaattagtcccccttcaacttaattagtgaaggaatttggcatctttgtaaacataaagggcctatgtggttcatgtatctttctgtaaggcaataaccgtgaagggcaaaggggcccttagttaattataacttgagtaggatgggaggggtcaatggcattttaacgtagaagaaccaagtgttagtaaagagcttttcttctccgggagcttggtcagctatgttttctgtgaagcctgattggggagtcaaagtcccagtggaaaagtgttgatgagaaggcagattctagaggatcaatatttcgaacctccttttaagctcatccaacttcacagctaaaaagctgttgaggcttcagaaaaaggaaaggcacaaaggaatgaatgaatcagaatttgcctggatgtgatgttcctgatgatggtcaaaagtcctgagagttccagccttgaggcctggcttccctctctctgcaggcctcttgctggttgcttttggaggaagctgagtgtttgggttgttgtgattgctgctgttggggatttcatataacatagctctggaaggtcttgtactcatgactattagttattcaaggccacctaaaatctaaatcaaagaaatgactagacagaagtgaaaaaaagggcctgattcgtgaaacgatttcccaactttgtgataggtcactcaaggcttagtgtaggcttttttcaaggtaggtgtcttttaggactgaatcggttccaagctatatgagaaagcttgtgtgtgaataggtttctgctggcagatggttggcaggctcaaccatcagccttccagacttgggattctaacaaaattctattctgtggcacaagcctagaataagtatgatccatataaatacattcatttatgcacatattagcagtacactgagttcttgtttttgtgattttgatgatctggtgcttttggttttcctaatactggttcatggagaaataagttgtactgtgttggctaaaacccgactctggatgcactaaataattcttctgagtttctttctctttttcctctagcctggaggaagtctgtctgctttctcttttgcagtctggagatagagcattgacccctgaagcaatgctgggtttactttattagagctcacccgcagatgttaatgaaagcagaacagtgaattagtgctgacttcagagcagaacaacttgggtgggggaatctgtgaagagaacatgttgttataggcaacacccaggggaaaattgacaaatcacagtaagaatcattggatatttctgccccaccaagagagcaggagggtgagaactaaatcatcctctgaaatacacttagattaagaaatcagtctgatgttcatttcacaacattcatcagaaagaaaaacaggactgatcccaggcaaaatttattggtgggaaaaatgtcgtgttctatctcctcctcctctctgcttagccccccagcacctgattaattaaaactctgccatctaccggctcagaacgtttttcttagaagcacctgagattcgttcagctaaagaatcaacagctgtcaaccgcagcaaatagatcccctaccctctaccatatcccagtatcctaacaatgccttaaaatgagcatcaagccgggtgcgatggctcacgcctgtaatcctagcacttggaggtcgaggtcggtggatcacctgaggtcaggagttctagaccagcctggccaacatggcgaaaccctgtttctactaaaaatacaaaaattagctgggtgtggtggcgggtgcctgtaattctagctactcgggagactgaggcaggggaatcacttgaaccccagcgaggcagaggttgcagtgagccgagatcacaccacttcactccagcctgggtaaaacaaacaaaaaaaccaggcatcaaaactcggatgtctacaggagtcagttaggtctcttaaatttgtaaaatctgcctggatttgacacaaaagggagtggtggaaccttggcaagcctgtgagttaagtccctgaccgaggcaggcgccactcggctttagcccatactggcaaggcaggccggtgctgtgagggcttccaaattttcatgagaagatgaaaattttgattcttctatgaaatctttcacatttttcatgacggttttaaaagttttacaggcagtaaaaacaattctttgtgcccttatgccctgaaatcaaaccctgtgggccagtaattcccaaatagagtcctcaacctaatatgctttccttaaagctaaatgtatttaaggattatctctttattttgatatttttatccttgctatattgttgatgtaagaatgtaattgcttttctaaagtgactcggggatagggttagcttttacctgcattcagttgaacttgaaggatgaccttcccaaaagggaactcagaaaatgtatctgactcttctaaaagacatgtaacttaaaagcataattctttatgagctgatattgagagctcccaatgggttgatggaaatgctaatgaaggctctattcaattgttaagtttatcttcaatgagcagccagtacagaggctccaaaccaaactagccagcttgccctgatgctggaaagcaaaatcccccaggatgtccacggttttgggtgagagggtctcaggaatatttacacagaagggagcaaagagcctgattgtgttcctggctttaacaagtaaagatattctgtttccatctgtgtaaatttgcgtgacttttttttttttaattttgagtaattaattgccaagactccatttagaaggaagacgatgatgagaatgaatcttgtgaaagtccatactgtactgtttctctaatggggtcctgtgaaccccctgcgatttacatattggcagaaggtccagtgtacactttgaatgtgatccaaacgttctagttcatttaaatttcataagttatagtttccggaaggagaaactgtaactgcatggtagcaagtatggaaaggaacctagttttcactgttatgccctgtcatttaacagtagctttgagtagtttttaaatcaaaaacaagaaaatgttgatgccttaactttttaaccccttgttcttcgtgcgagtctatagggtaagttcttcttgtggaaaacacttgggttattttgggcgaggtggcgctaacagagttttgcttgaggatgtgcttatctgattctctcttcccattcaaatataggattgattgttttcatccttggagcacccactaggtacaaccctgttggaaaccttaatggtgaaagcagcgtctattcattgaattctttttaatgtgtcagaaactgtgctttgtgaaacacaggttataacatttatttttcacaatggtctatgagagaagaatataagagggatggtctccaagataggaaaaaataccgcctttgggccgggcgtggtggctcatgcctgtaattccagcactttgggaggccaaggtgggtggatcacctgaggtcaggagtctgagaccagcctggccaaaatggtgaaaccatgtctctactaaaaatacaaaaattagccaggtgtgatggcaggcatctgtagtgtcagctactcaggaggctgaggcacgagaattgcttgaacctgggaggcagagattgcagtgagtcaaggtcgtgccactgcactccagcctgggcaacagagcaagactccgactcaaaaaaacccagaaaacccaaaaacaacaaaataagtaccatctttatttcattgtgcggagagtgggagaggaaggtacagaagtatggtgggtttgcgagtttagtagcaggaaagggagcgagttcttgtataagggggtttatttccttcatgacatacaaggggtgaggctatattgagagaagggggtaaggagagggtatggaggttggaggttggaagagattgtaaatggttgaccagaagaaggtagatgttccctgggcagtgttgagggtagatgttttccgggcaagtgatagttggtgctctgtggttgactgatcttcctgttgcatggcactctctgcagtctcaggtgcttctgtatcaggagggacaaaatggtattaaagaggaattactcatgacactcgttcaagatggtaaggcagactttatttagtaccatcacgataggcgtagggaccactgcagtgggatttttgcagtgagggagagagattgagctcaattctgaacagagcatggacaaataggaatttatagccaaggagtggagtggaggtcagtggatggaaaattactaggaggaaacatcagggctataggagtgaagtaggggaagaaagggagagaattctggttaaagtgatcctgacctattataggattcttgttgaaggcaggccagggtgatcagataccatctggggaatgggagaggatgaggaacccaattaattagtgggggtgattagacatagagggtggggaattctggataaactgacttagagttcttgccaaaaccagattttataaggaagtgtatacacggatgtaggagaatgtaaaggagcctgactaaagtttggtcaagcaaaaaatctatatcactggtcagtgagtttgtctaggtttgggggtgtgttgggggctgtgctaaaaagacagctagaggagcaagaaacactggtgcaagatcaagaacattatttacctgggccatggattctaagttgggtaaggagggaactgcagaaaagagtgagctgatgggagttctttactaagggtcagacaaatttggggaaggtattgcagtggggaaaaaaattgttaggacaagagccaggatgttctctcacaactgcatttccacccttgcttcaggtgggggaactgtttacacattccacaatgaagaacaatcaagctgggcattgtagcacatgcttgtaacctctgcgctttgggaggccgaggcgggtgggtcacttgagatcaggagtttgagaccagcctggtcaacatgacaaaattccgttctctactaaaaatacaaaaattagccgggcgtggtggcacgcgcctgtagtcccagctacgcgggaggttggggcatgagaattgcttgaacatgggaggcggaggttgcagcaagccaagatcgtgccactgcactccagcctgtgcgacagagcgagactctggctcaacaataacaaaaaagaacaatcagtatgtcctttgctaagatgactcctacccacatgcagggaggcttttttttttttcttttcttcgagacggggtcttgctgtgtcgcccaggccaatctcggctcactgcaacctctgcctcctaggttcaagagattctcctgtctcagcctcctgagtagctgggattacaggcatgcaccaccacgaccggctaatttttttatttttcgtagagatggggtttcaccatgttggtcaggctggtctcgaattcctgacttcgtgatccgcctgcttcggcctcccaaagtgctgggattacaggcatgagccaccgcgctcagccgcagggaggcttcttaaaaacctgtttagtgtctctccatagccgcatctcattgtgtgtgtgtgttttaatatattcatgctcaaaattttgagaaatgagtaaatgggttgtttactgaatgtaagcttctatctcttatgcactgaggcacttgtttatcagtagacctaagaaattatgtacatacggatctcatctcagaggcttgtaagagatgtagattcctgggcccagatctcagaattcctgaatcattactgtcaggcgggggcttaggaatgtgcatatctgtgtattaatactctgaagacactcagagttctagaaggtgaatgctgtcattcatgttcatcttaggccttaaatgtagaaaatactgacgtgtaaggaaaagcaaaggtgaaaccagcaagttaattttgtcttgaaatgccatcacatttaaagcacagttcttcagaaatcaagttagagggatattgcatgatatttccctctgtttatctaaagttatttgtagtatttctgtcctgtgtatgttatgaaaagtcacacacgagtctgctcattctttgagagtctatatttactaagtcagaagatttttttttttaaaccctgaagcatgagagattttgtgagaaagaaaatctttgcaccttccatttttagagaaaggaatagtagagagtcaagtgtgaaaaccagccactgggtttcttgggaagaaaaaatatagtgttaatgagtaagaaatgttgttttgtatgaagaaagatattaaaatttatctaagggcaggttgagttacaaggaaaaaaatggatagaattagaaacaattccaactgtgactattttaaaatgaaatattaaatttgttacaattgaacaaaggagaatttagaattaatgaattgcttttcttgtaatattttctttactcatttcttcttatttctttaaataaggaaacccaagtcattacttggcttattattacaggttatcaacaacttagtaaaacgtgcatgaaatctgtaaggtacagagcctaattcgtcagtagctttggcagctagatgtgctgattcactgtctacccattgtgacttcagagtcacaggactgtgggttagaagaaggatactaagggtcatcgggctccagccggctccagccgtgtcttcgagtgtctgataatgagttatttaaaaaactgaaacccagaatcacacctctcgttcttgcttagctagtaatacaagcagacattcataccttgatttcttcaacatgtaattggcttgtaaatcagggcggccatataattgatcatccagattggagtacttttcgagtgaaagggggcattgttaataattatgccaggacagcaggcattttagatttgtactctatcacaaagctaagttctagcaaatggttttgaaaccgtgtttagtctgaaagatttctttagaagttacatgtgaaaaaaacttacctagattgaagtttatttgccaaggtaactagggtgctgcgtactatgtgatagcctggttacatggaacccctagggaaatatctcgtttttatgataaaaatttctttagttgaaaaatttgtgcatttatttctcaaatcaatgtccaactgttttaataatttctcatatgcagcttaagattaaaattcttcatagagggccttttattttagaatatggtctttccttggtatctatggaggactgattctgggaccccctccccatggataccaaaatcaatgaatgctcaagtccctgatagaatgtatttgcctaaaacctatgcatatcctcccttatactttaaatcatgtctagattacttataatacctgatatagtataaatgttatgtaaatagttgttatactatattgtttagcgaatagtggcaagaaagtctgtacatgttcagtacagatgcattttttttcaaatatttttgatccatggttggttgaatccacagatgtggaacccatggacacggaaaatgtactgtgctgcgggaaagtagtaatatcaggtgtgatgggggtggaggtagatagtatctagactagaggtttccaaactttttcagtcatagcatctttagtgtctcaaaaattttcatggtgcctcctagaccaaaagaaaaacctaaccattccatttattaagtacttaggtctaaacaactatttatgttctactaatttagtggctgtttgagaaaatattacatataaattgtgaggaaaaaactcattttattcttctaaaagcataattacttatcaatatgtgtgtagctatggggcactgcacagctttcacacgttgaattcagattgtgcacacacttcctttcctgttcagttttcattttctcttgttacttgcttttatcacagcaactgctaaaaaaacagtttcgcaaaggtaagatgttatggaaaggaaatgttgcgtgactcagggtagaaacttgaaccacctcaggctagtggcttgtgcggtctctgattttgagtcttgttgcttcctttggaaataatcccatagcttccattcatttcactgtagtgcttgggggtgccttggcactcaatttgagaaccacagatctagacatttctatttagttcattatttggctgttagctaaacatccattgtgtttatggcaccagaaatttttatgtctgtgtgtgagaagctctcaaagccattatgttaaagaaactaagatgctccagcactttacccctcccttctttgaattaggttgtatcatattctggtactgaatagctaaagtttattgaacacttatgtcaggcactgagcttgatgaaacactttgcatgtgttctctcattttctttttgattttcataacaatcctgctatataaagcttcttctatcaggctcctcctgaaatccgcttggagtagatactgtccttattttacagatgaggagactaaagttcaagtaatttaagtgatttgcctatgaacatcgagcaagtagtttcagttctgtgatataaacttaaattttcttattttacctgaagactagaatctttgtctgcagccacagcctcttctgtggacactgtgctaccgtccatgtgtctactactgttttgataggtactttttgtgtttcgtggtggtcctaacagggagatctttttgttctcattttcaaatagaaacaccgagactcagagaaatttagttacttgccagagtgaacagctagtaattggaatttgaacccaggtatgagtaattccaaaggttgtaattgtaatttattgtgatgaccagaagacgttttctaaaattctggagttatttcagagtcattaaagaaagattaagttacgataatatggcttttgtgttaatttgataaatcgtattcacttagaaatcatgcatggtatgtgtggcacctctctattaaacagtgtgcctgttgcccaaccatgtgcaataacagagaatatattgtgcttatcatttataaatatatgtatagaagagagagacaatgaatggacctatttgtcagtgggcagctgactgggatggaacactgcagcaacgctgaaacgacagacccccgagataggatggtgtgtggaggatcagattttaaaggcttgtttagggaggtgtgtaagtgctaagtagtttctcaagttgaaaattaggaatctcttgatcctgtcacttctctataaaacctaataatcaaacagggattcatttgcacttggagttgcatttccctctggaagaagacagatctaaatcagaggtatgcttcaagttggcaaacactttgggtgggaagcaacattaggtactggatgaagtgcgttgcattagccctgggctccttaggacttgaggtgtaatttgcagaaggatagattggttcatgtgagttagctatggttcatctcttgagtgatgggggcggagttgttatagaatgtaagaatgcaaagattgaatggtcaatgtggtattttggcattcttccaaatccttgtagctcttttggagaagcataacactgctttgtaggaaagagaaaagtgtttacatccagaacatattgagtgggtgtactgagttcagcagccagggtcgtgtcccccaggcctactgttgtggtttacccagctgagacgcacagagggtcaatacagtcagatttctgcatcctgccaccccccgcccattttcatctctgtcttgcatgcatgcttgctttttcctttttcttgcccacaaccaagtccagcacttaaaatggaatagtgcacactctagggcctgcttcccagaaattctttgtctgtaaatgtaggtgtgcgcccaccctggaaaatgctttcttcttattgccttgcttggtgcatgcagtgcacatgtcaccatgcttccttgttttaggctgaaaccagaccacacacttgggtagcactttacacctagaatgtaccactgtggtgtgagaatataaaaccaggcataactcaaatgacatggattttatttcacatgaacctttttatctccaaatagacaaacattgaaaaccttatgccccaacaagaaagaggtacttcttattgaggtatctaagggtacctgtttataatatgatttagttcagccatatttaataaataatctattatttaatgttatagttgttgtgcattgtatgtataaattctaaatttccatgtaccacacatcagaattaattttattatgggattttttttttttgctcaactcataactgttagatgtgtattgtgtatctgtccatgttctgagtattatagaaagcatccaaatatgccagagaactttccctctcattggataaaaagtgtacacatgtgaaatggcaaccaatacggtcacatttggtcccttgaacaagtgctattagagataatacaaagaaaaggtcaccccaaacatggtatatagaagactcaggtcttgggttgagatgtaagtttgatggagagaaggtgagtgggatggtaggagaggcaggtcaggtccaggcctggagtataagagaaggtatatctgtactctggaccttttttttttttttttttttttttttgagagagggtcttcctctgttgcccaggctggagtgcagtggcacaatcatgggtcaatgcagcctcgagctcatggctcaagtgatcctcctgccccagcctcctgagtagctgggactataagcacatgcagccacacctggccaattaaaaaagtttctctttgtagagatgggatctcactatgttgcccaggctggtctccaactcctgggcccaaatgatcctcccaccttagccttccaaagtactgggattataggcatgagccatgatgctcggcctatctggagcttttaaatatatatttttaactttacagagttgaagtaaactctgttagtatttgtataatatttaacaaccacgtacaaatagataatgactaaatttgacacttgcttttctgttcctaattacttatttgtttaaaaggagattaaagatcttggagcagaatgccttttgtttattgaaatgcagcttgtttggctgagcagaattctgttagacaataattatgcaccatctgaatacaagatactttattggggtactgtggctgtaaagaggactaacaaattatttttccttccagggacttggagttttgtaaggatagaaagagaagtcagtaaaatagaatgtgattggtggtcccctcaaaaagatcttgatgttgttgagttgctcttatgtcagttgttttgggaattcttctatttttatgacatcttaaggagtttagcagtttaaaaaattatgaaagtgttcccttagacattatgtgtgaattaacttgttgattgttggtgttgaccataaaaataccagcaacgttaaagtattactttaataccaggatgtcgtacacacagatgcaaacacttacttcatggtcttttccgctaccacgaggggtgagagccaaaagctaagtggcaggctaaaggagtgcaaagaaggagaaaactaagagcagaaaaattaatccacttgtcatacaccagaaggcctgccacgcaagactttccagctttcctgcctatcttggctgggcttgtctggagagacactgtgggtttctggaaatgagaccatcaagactgataaacacgtgttgtggtgaaaccttaagttgtctcagtgttactgtgtgtttggatagggcagaactttacttcagaacatggctccttcatgagttgatagttttatttttaatttttttggtaatttaatcttaggacatcataacttcaggtatctgagtctctgtttttaattcctttgtatatatacctcattgcagaaatgtagggtcctctgttgagtgtgtggtcaacattttcaggaaccaccacactgatttccatagtaggtgtaccattttatattcccaataacaataaacaaaggtaccagtttttccaaatccctgccaacacttattccgcccccaccttttgaaattactctttcacttttaaggaccctgtgattataactggttcccaccaaggtaatccaggataatcttcccatcgcaaggttcttaatcatatctgcaaatcacattttaatatgtaaggaaaattcacaggttcctgggatagagatgaggaaatctttgggggccattattctgcctatgacagcaagtctacctttgaagttgcagctgtttgcaaatgagaagccatgaatttgaggctataattttgatcatggttatggcaaaaatattcatttttaagacaaaagcataatctttctcttgttatttcagaagacgtgaccttagttgaacataaacttgaactcttttcctcctttggtgatccccatcataagattgaatagtatgaggctgtaacctgggccaagcttgagtatagaatccaggttcagtaatcgtttccagagtgactgctgtgaaagagaagagggagactagcgataatcttaatgtcctgagaagggaattacagatatgttgctgggaaagggctgggggagagtgaggccagggttccagggcagtgggacaggtgaaattatatactgcttcagatcagcaggtgatacagactgcagtctcatggctttcttgtggtagaatcttgatatctaatatgttacaatttgagtttggtatcttcagttatcaaattgagtttactcttcagatcttatcacatagaaagttgacattcaacagcagaataagaacactttctctggatttcgatgcattttggtctgtgccagcaagcctagtaccttaatatatttggcctcatgttgtctaatcattgcccatgaaggagttttctagcatctcaagtgtggcctcttgtgtaactccctcattcagcacacaaatgtgtggattcagacacagctcctggcacagcagttagcagacagtaggtgaagagttctttgaaatccagaacatgtcaagaatcgttagacagcagacctctaatgaaaatcagacatgaagtttgaaaaaaattgcatgagtgattctttccattattctctttgtgtttaaatgcaataggaatctgtattttaggggctggcactttggccagaggagggatgtgtggtttttccatctattagatgttgaatcactaagccaatgatatggggagtagtaggaagatgggctgcgggagagcttgtccttgactgctatagctgcacccttttgtcctgtggacaagattggctctcccacctagcttggtctgtattgatgataatctggccttgcaattaaataaataccataaacataaatatgtacatagtgagctccttttttaatgaactcctgtttatttgcatttaaaaaggatggcaacagtgtgactactttaaaacagtagataattcacatgagatttagggaattcatttttgtctgttaggttgtgttcactggtttaaaaaatggataattttctagaggttcataaattaacaaaatgggttgttttatgtggatggagcccaaaatcaaggaggaatgaagacagtggcaagtgctggcacttctgttctaagaaaactatagtcaggaaaagatggaggtgcattaaagtagcaaatttcaagtgttccaactactttacatgcgttatctgatttgatcttctgaaacttctgtatgtgtattcacacacgtgcacaaacaccctccaacatatgtaagtgatccttctttcatgttaaaagagaaataataagagacatgttggcctgagttctctttaacagcttcattgagatataatggatacagaaaaatggtatattttaaactgcataacctgatgtattgatatacagttttgtgttgcttaacaatggagacaggttctgagaaatacatcattaggcaatttcatcgttgtgtgaacaccacagagaaatgataaccacctagagacatgatcacgagagtcagactaattaatatatccatcatctctcaagttaccgtttcctccttttttagtgtgtgtggtgaggacttaagatttaccctcttagcgaatgttaactatacaatacagtattgttaactagagtcaccatgctgtacattagatcttcagaatttattcatcctgcctaactgaaacttgaccaacatctcttcatgtccccctgagcctgaagtctttgctctaccattggtaataaccagttctgtgaacttggacaaatgctttcacctttttagtctgttttggtcacctataaaagacagaacagaatgaatgtatcacaagcttctcttgtagctctgtactttttgattataaaaaagttatggaggagtcataagaaagcaagccttctaagaaaatagactgtacctaagattgtgattgagagattagaggtatgtctcattaccacagtttccccagaaaggacagctttctagtcagcttttatttccaagatgttactagattagggagagcctaatttctccctttgtgagcttcactggctacggcggtgatattagtaccctcaatgattcaataaaaataacagtgacaatgaaaaatgactgactggtgattcactttggggaactatttggctggctgcctgagacctgtgccaggaaagaagctgaatagattttagcagcatcctctaggctaggaagataataaaatttaggatgccaggtagttgtttggaccatgaatataggtcatggaaggaaatggattttaggtgaggggaattgatgggcaggccatgtgctgaatttgcagccaccctgctgaggccctcagctgttgtaattttcaagtgaactcaggagaattggtacattactcagttccaagtgacttaatttgatgtcccaataatggtataaggaaaaatgtcaatgtaggaagagttaacagagcaggaggaatcatttacctcatttgatttgaagaccccttgaagacttttcctagatatttctttggccgatgacttctcactgccatagagtaagtttgaaattatctggtttgatgtccacatgaacttggtctcacgctacccactccttacctcctggtttattctgtgtgatgcacagctctttgccttctcctgtgttcatgcctttgttcatatctttccttttacctaaaataatgaggataatatgaataatatcatttaacatactgagtactttccgtgtacttacttttgtactattttatagtaatcctcccatatccgtgggggatacttgtcaagaccctcagtggatatctggaaccttaaatagtactgaaactaatatatactattgtttttcctacatatacatacctatgataaagtttaatttataaattgggcacagtgagaaattagcaataagtaatcataaaatagaactattgtaacaatatactataataaaagtttatgtgaatgtgttctctctctctctcacaaaatatcttattgttctccacgaacctattttggggccatggttgaactcagggaactgaaatagcgaaataacagaaagcaaaatcatagatgtgggtgaggctactgtacatacattatcgaatttaattttgcccaaactctatgatgcaggtagtaacattaccaccatcctcatcaccctcatgatgcttatcactaccatggtgatcatttccatgtcacaagtgaggaagctgagatttagtataaataacttagctgagatgacactctaaatgagtggtagtcatgattgcagcccaggtggcccatctccaaagcccacacattagaaaccatattgtgtcatttaatgccattctttaccatcctccccacacatccaggctcaatgcatagtattttctactttccgtagcaaaaagtaatggctccttctctgaggttctgtcggattatttgacatgctccgttttatatttgtgtattcatcttctttccttctgcttcattgatgccttgtcaaagcctgagtttaccatgtatttgtatcctcaccttgatttgttatttggcagagtttattaagtatatattgatttgacactgtaccttgctatctgtattcagcccagtcagttttttggctccagtttatatttttcaacatcttaaaatacttcaattaaaatgccagtatcttatatgaaaatattaatatcatgcatttccaccttcacttttcgtgctaatgactgtgtctggttatttaagtggaattgtgagattgcttagttcaaataagtcatattttagaaacattgtagtttaaatgtcatggaagggggatgatcatacagacctctattctgagtcctggctttgccacctacctcatgcatggaggaattacttaacctccttgtcctccgatttccttctctgttaaatagaaaagataataactacttgtcaggattataagacagactaaattggataatgcatgcaaagagcctaagtgcctgagacataccagtccgtcaataaatggtacatcttgttgtttttgacccttgatttcgattcttcagttttgaattacatttactggctttttcgactgtggggtgtttactaatttcatttgctttaggattcaaatagtgtggtttaagatcacccgtaattagtagagtcaggattagaatctagctagtctaattccagagcccaactagcaaaaactaataaatgagtaaatccttgcttgcaccgtctcattagaattcattgtgctacccagccatccagttgaaatccatcccatttccttttttgtagcgacaagtaatggctccggggaagggaacatggggagttgttgtttgatgggtacagagtttgttttgcaaaatggaaaagttctagagatccgttgcacaataatattaatatagttataaacactacttaaagtataaacttaaaaatggttatgaggtaaattttatattatgttttctaccataactgaaaaattttttaaagtaatgactccttcttttgagttcctgtaaacctctgtatctctattatttaagagctctaaaagattgtctaagccatttcttttgtgacatgattttccctgcttccataagaagcactacttgcaaagtccatgttttttctctctaagcaagtggttatatagtagaagagttcctgttataaaatctggtgactgaatgcttgtgagttttaatttagagattacaaggacaaagatatattacataaggtgtatttcatactgttcaatttccctcctgtgtgtctccatatcactgtgggtttctaagtatgagccttgagaatatttgggtaaaagaaggattttacaagtttgcattaataccatgaaaccaggtcaggagctgatatcagaaaactctgttttgctaccacataggtctatttggttgtgaatgatttgggcaccatcattctgttctgtgttgtgtatgataatctgtgggtataacttgagatgtataggctaccatagattcttcttcaccataattactttctttataaagtactcaggaattttgggatattctatttttctttattttctagttataatttctattttcaaaaggttctgagatggaaaacacatttaaaagcaaattaagattgtacaattatggataaaaaccaaagtagagaccatacatgtaactaccacttggaatagataccaatctgaattaactggcactgaaacaaagttcagattcatggtttcatggtttattgtatgtggcagaagacgctcatttttcttttcaggaaaatattgctagaattgaagatttttttcccccgtgagttttttttggaaaataataagcaacagatattatcatggaatgatgttttacaagaaactgaaatactgttcagtgtgtagacattgttaatagctataatataaatcctaattcattaaggatatttgcaggctgggcagtatggctgattttgtttgctcttcagtattcaacaacctgcttaatgcctaccgtttgccatactgtgccatacgttgatggttaagaagaacatcaaaaattgttcttgaagcactcagtccagtgggaaatttaggtaagcatacagattgttagggtacagtgtactaggtgttatattagagacatgtaaacagtgctgttagagcccaatgagagggtatgtcttcctggagtagtggggggaaggttctaatgataaatgacatttgaattgattcttacagtttgccaggttgagagtggaaagaaaggaacaattttacagaaataatactcttggatgatctaatttattttagctaggaacttgtacaatctagaaaaacaataattaacatccactgaacttttcaattcaaatatcatatgtcttccatcgacctttggcgatacttgcaggcagttacttggtgattaagttgtctcagatgcctacagtgcggacattctggtatatggttaaagcccaggaaatatgttggatggaacaatggatgaaaagaatgaaaggagagccctatgtcacagatgtcactaagagtgggtgaggtagagttgtcaccgtgttaggaagactcggaaattgattgatattttcagccaaatagatgagcagtccatttttataaaggcagcaaagggacctggagatagagccaatattttcctcacacagtaacttggactcatgaattacctgctcaaacatttagcttggactccagagtcttgccctgaacagcacaagaggaatgagttcactcgaaagaagtttaaaggcagttattaccagctaatcacaacatccctgaactttaaccagacctctgtagagtgtctgattttaaatagaactgcttcctcatggtccttatggaattattaagctgtacaatgtatgtctgagtagctcagaggcttggctcatggaaggggttattttagatgcttggtgaatgattacccagtggagctttagtttggatgtattgatgttgcactgctacttctgacaataactaatcatgctcaaaaagacttcttaagtctcttcttgttcagagattcagacctttcttttgacctccagaatcatgtatctacctgcccacttgagtgctctcttggttatctcatagctatctcaggcctaaacagggtcatttataaatcttattcttcaccaactcctccagatttattttgccttttgttacgtgcccctcttattaactgtaccccattcacttagtgactcaagctggaaacaaggtacaaatcctccccagcccttaagtctaaccagtcagtttcacttaatatttctgacatttgtccacctttcttcattcaacgtgccatcgaccccatctaagctgccatcattcacttgaactgcttagtcctggcctcctactggctctctgcttttgctgtttctaatctgttctcctcatagcacctattgttatctttgaaaaacaacgtcattatgttatttatctgcttaaaagccttcaatggcttcccgtggcacttcagataaaatatattgaccctggtctgcatgtctaggcatgatatggctttgactcacatttccaacttcatctttttctcattccttctcttttactttctctctggctgttctgacttttttcagctccttaaatgtggaaagctaattcctgcctttgaggcttcccttgttcactgtgcccagtgtgctttcgtccgccctctgcctggccaatccttctcatttattgggactcatttgttactttttcctgagaggtttttccagactgtctaatctaagactaccctctgataacctttctcaagccttaccagagtttaaaaagctttgtttgtttcatatgtgtctccccaccataacacagtgctctctgggcatcgcgtctgtttggattcccaccgtgccacccagcatgttgcacagggcttgtacaggggcagtgctccataaacatttgttgaacgaaagactctttaatcaaaataagagttagtctggaaggggcatcttgcctttctctttgcagaaaacgacagagcctgtgtgtaattcctgtggcgatgtttgccaagtgcttccacgggaatgtctagtagagtactaatagaaggtcataagctattgccgttttgctctcctgcaaaaaaagcttggtggcatattcagaatttatccttgggagcctaacagactaagtttaggtcctgtctttgttcctgtaaagctgtgcaaccttgagcaagttaaccaaattctcccgggtctatttccctatgttaaatggagaagattatgtctatcccacatgcttattatgagtattaactgagattacatatgcaaagtgttgaatggagtacttggcaccttgtaggagttcaggcattctttttcttattccctttatatctcgagattagtgaggactcaagaggaaaagaactcatttaatttataatcttattgttcttacttaatgcataattatagctggggtgctaacatgaaggtcaacaccagtttaagaggaaaacctccttctctggagtgcaaataagcaatgatggactgaccatttaccagtaaataacattagacttcctcagaaagatacacatgaaattctcctttgccttatcccaggagtttttttttaacattgtcaaattgtaataactaataattacaaatagactttttccattgtagttcaagtagatattccatgaagacaggccatatgaaaacattttcccatattagatgtttctatatctaagaagctttggcagtaccattgaaaactctttataaagtccaaagctcttcaaagtaattgtcagctttgagggggggtgattaaaatattaaatattttaggccaggcatggtggctcacgcctgtaatccccgcactttgggaggccgaggcgggcggatcatccaggggtcaggagttcaagaccagcctggccaacatggtgaaaccccgtctctattaagaatacaaaaattagccagacatggtggcaagctcctgtaatcccagctacttaggaggctgaggcaggacaattgcttgaacccaggaagcggaggttgcagtgagccgagatcgtgctattgtactacagcctgggcaacaggagtgaaaccccatctcaaaaaaaaaaaaaaattaaattaaatattttaaagacaggttattgtaaaatctgatggattagactcaaataggtggcagatatacttaaggcataccaatctagatgttagattgagtttaagggaaaatgcttggtttaatttatcataatcagtggttgattttctatcattaagtcaggacagcatactcacctttgcctctgttaaacttgtttcaccctataacacaagacaataaccatgaccaggggaattgtttctccctaagccaagtccttcagagagctaggagcttgagtattaaaagttcaagacctttgcatttgtctgcttgaatattgacccagataagggactacattgtttatttaggaataggtgtgacttagagtgctgatgccaggggatagacaggatgataaataggtataatactttaattgactacttagctcagttgtttagcacatgagaactttggggaggccaaaagaatagatctgaattctttctgaggctctcttactctgccatggtcttttgccaaagacctcactttgcatccaaacctagtatcttaaaaatgtgtatgattggtcatttgggacattagattcatgacatgtgaaagtacctgggaaaaaatccatgaccagcactacagaaggtgtgctgtgttaagaggagggtttatacgagtgctgatgtctggacatctcttttgcctcatgattaatttcctactgcaaactcaccttcataaaccaatatagctcaactgagaattgtggttattaatgttgacataaatgttaacatatgtcctcaaggaatactgtcatctcacagaggggacaaaaaatagttgcattgttgtcttttttttttttaattcttttcctcatagttgtttatcaaagtgagtataatttgaatctatcagtgattctgatcattgtgttctcttttggtgttttctgttttgtgtctggtggggctacagtgctttacaaagaaattggataccttgtgacctttttgttgagtagaaagggagtctgccaaagcgacaaggcatcacctttgctaaaatgcaagtctgattgttcaaagcagatcatctcacatgtcccaccatagaacttcagaatttcccgcctctcatctaaccgatttgatgtttaagtgacttctgtgggtgttttggtttaatcagatactaggaattgagagaaagtcatgaaaaaaccatagtggtattatttggtctgcctgcaagttaccaatttggaagcctgctgtggaatgtgacatcttttctctctttattttttttaaacagaatgctatgaacctacctcctgacaaagccaggttactgcggcagtatgataatgagaaaaaatgggaactgatttgtgatcaggtaagaaacagtgacactttcttttatgaaaaaagtaatgaaagaagagatccagtgtgaattttatggtatgtcaatatcatgattgaaaaacaagatatttgcttctgcgacagagataggaaaaaagaagagaacttcagagaaataacaatatgtttgtgtggatcttctttggatcccagtttgaacaagctaattattaaaaagacttcttgagaaaattgggaatatttgattagtgactgagatgcttccaagaaattattgttgattttgtttgatcgtaaagtacatagaataatactgggcacatagtaggtgcctctaaacttgtgtggctgcctctgttgctgctgaagggcccagatattaaatattgtgactgttactgtttttattttcaacttgtccttaaaagattcagagaaagttatatcaagttgatatggtttggctgtgtccccactcaaatctcatcttgaattcccacatgttatgagaggaacccggtgggaggtaattgaattatgggggcaggtctttcctatgctgttcttgtggtagtgagtaagtctcatgagatctgatggttatcataagggggcgtttccctgcacaaactctttgctcttttctgcctccatatgagacatgcctttcaccttccgccatgattgtgaggcttccccagccacatggaactgtgagttctccattaaatatctttcctttgaaaattgcccagtctcaggtatgtctttatcagcagtgcaaaaacagactaatagacaaatatatcattatctgttatccaaacatactttatggtttgaatagctgttatatgatgctgtcagaaaaagcctcagctatagatttccagtctaaaaatattactaccaaccttatttgtgaagccttaaaattatgactgtggggtggtgttgatatccaacatacaggacacccccgggccccaatgccgtgtgcacgcaaatattaatacaaatattaattttacttcttggatacaaatattaattttacttaagcatatagcatggatatagtatatgttatttaggatacatgttaacaggaaaggtacacaaagtgatagataatgttaaagaaattgatttccaaaagaaactatataaataagagtgtgaggacttatggagaaattatttcaggtttcagtttcatgaaaaattaccatatggacatggtgaatcatggaactggtcattgttttccttggctgctaagatgctcagagacagatttgtggcctgagccacaaatttggtataaatgcttataagagaccatttataccaactacacagtacttcaatgacatgtgttttaccaacctcatccatggcttcatctcattattcctgcctgcattttccctccacactgatatcctcactgaaaaaaacttacatgaagttgtaaacttttgtaaattatcattttgaacaagatatatttaaatatatcagcattactggtgaacaaagattattcttgcattgataactaaactgaaatgttctctatgctataggcattgtacaaattagtgcattgaatctgttctgcttctctctaaggaagcaaatatggagtgtcacaataaatgctttctcatgacttgactttatcatgaagtggccgttcattatttaatttggggcatccattttttcatacttctgtatgattgcattagtctatcactttgttttgtaagtatttatttaagtgtgtctccctcaagagtaagttcctttaggatatgggcctctaacaacttgcttagtgcttgaaacgtgcttattgaaaacatgttgaatgaaagaaataatggctaatatggaagacagtggagaggaagcttgcattattggcagagagggcagaagggaaaaagcagttgaaagaggtggcctggaagactaagcagaagtttgctgtttccatatccttctcaccttcctctacctgtcagtgtggtttgcttttggtaaaggaaagcaattcactgctcatttttaggaattactttaaagagagaaggataacatttttaaatgtaataattcagtggtactaaatacattcatgttgaagataaatatttcttaatatgacagatgctgataggaatagagaataaattccagaaattctgtcccaaatttaaccaaattaagattaaatcccaaagagctttctatagtaacaatattgcagaaatgcctcttggtcctttcctgactcattgcataaatacaaagatgacctgagcttctagtgggtctcaaaggtgaaagtaacatgggagacgtgtctaactaattctggagggagtggggctacggaagccacggaacagagacatctgtgctggattttgggtgcagtgaggtgtatcccagcgtacccatttctgtgttatagtaggtgaacagagttcccatgaagacattattaatttaaggactctgtggggacacagaggcaaattttgtagtgtgagcgtagaaagctagaaatgtcaggtttctttgataactgcaaataaaacccctgaagctacttagctgtaagagctctttcagtggcatttacacttatggaaagagagaaagccccttaatctcacttgtgcctcagtttttggtgcagaccctgtgctgcacgttttggttttggagctttggccatttcccgtaagtttagaactcttagcacagtgggtactgtggataaatgctggtttagggggtttagagatcctggatgaatttagacttttagatcatttatatctagaagggctgttagagaccatttatcccaagccactctgactttactttttctattgaaaaagttaacacatgcttgtccaagaaagcttgtggaggagcatgtggagtgaagtgcgcgtcccttcgcctttcctatctgtttcccaagccccttattttatagatgatgaaactgaggttcatagagcctaaatgagtaggccaatgccaaggtcacccagatagtgaaacgagaacatctgtttccaaactctactcacaagctttttcatttgttgcctgttataccagggatctggaaacaagccattgaagcaaaaattatagtaggtaagggtttcttaccgaagttttgtgtgtggctgctcaaatgatttagggggtgcctacagaacttacaggttgtggattcataactgtgcccctgctggatgatcaagtggaagtggttagtcaaagaattcaggacattggagatgactaatgcagatgggtgtagattccaccaacatataatccagtccagaagctgttagaggtgccatccctatgctgggttataaaagcttccttctgtgtttgctgttgctgagggtgtgattggttattttctgtggtgatttggcatgagtggaccttgcctcctgatagctggctgttgctttgcatagtagccttggggcaagggcccaacggaagggtgagacatggaaaatctcccctttctttacttatataaagcgatggagagaagcagattaaaaaacaaaacaaaagatgagcgtgaagaggtagcaggaaattgtagccacttagactcagcttcctgtgcgaagcgtttcagggaggtcagactgcatctctccaggcttggcatgggtcctgatctagggaaggggaagccctctgctgccactcagccggagcagagtcaggccagtggcactaagaagcctcattactctcattgtgagaggtgatctcttgtctttttcaacacagctgacccataccatatacatgtatttaatcattaagaatataattttttttaaaccctttacttgtggtcaaatactatttctttaaaaaagaagggcaggttttttactggagaacgtgcatcaatatttaagccaatttgccattggaattaaattttctaaaacattaaagagcaaatatatctccatggtttttagtgttggttattttttttgaaagtgttcatgtttttgtgagccagttaaagctctttcctgcctagtaaacaagtactacagaatcctgataaattagttcctgtgggccattccaggtaaggaggacttgtccttggagcaccaggggtgctaaatgagtagtgacagtggtggcatttttatagcctattttgatgttggtggctgctatgttagagtcatttgagcaagcataggaagagcagagacagtggtgaagaagctgaaggaaaagatggtgatgccagcaataacctttccctggccctttccctcctttttgctcctagacttcagacttagtctgccttttagccctgtttcccaagttccaggctttgattctacatttagctatgctcactcctttctggcttctcactcccagctgttgggatagcagacagccatttctccctctccttctcctcccttccttctatcctctggctaactgacatgcttcctgtacttaatatgttaaattggttatatttttatcaagtttacaatactgtggtatgattaaatgctattttaaaattattaggtttttgcgatctgtttaattcttttcaaattttgtcttttgacccttagttttctcttatcattttgatatccagtcttccccctctatacattcattcttttgattgtgcattagtcagattttttgtttggtatttgttttctagttcatcttttttttaaaaaaatcggtatgcaccttataaaatttttctcttgtattcaaataaggtcatcacaattaaaacgaatagtaatttcttaatatctcctgttgtccagtttattgttctcaattttccttaagatgttcttcctatctagtttgctcaaatgataatctggtacaggatcagtcacatattgtatctggccatgtattccttaaattactttaaactggagtagacttttgtttatgatgctcatgtggtgaatatagtaggcaagccctcttgtagaaagttttgttttctgcacttacctgtttcctaggggtgccttagctcctgagtttcctgttaactagaagttagacttgaagtcattacagattgatgttgaacatctttgtgaagaatatcatagaaaaataatgtctggttgtcccatcattaaataagtttggccagtgacaacttgatggccccattgtgtaactgttttccccttgtgctggagagaattctgtttggtgtcactttgtcaccatatatacgtccagttacctatcaaccttgtacctaatgggtttgaaaccaattgataatcttttgttgaatcagtttcattacaaactggaaaaagattattttctaatctctctttccttctattaatacagtaaactagtaactagagctttcaactgggacttggtttatcctggaatataattattcctggaatttttcccctcaattgccatttttttaagtaagaatttggattaatagatacctcataagatgaccagtgggttttctgtggtctccttttttgaatatcactacgaactcatgaattttcatgggttcatcatgtttcaatcaatgtgatattatttttgaggctcatatgatcacttctttgatctatgggaatcccttggtgctggttcttgtgtccttttcacatgaccctcttaatccttgagagcttgttttatggtatgaaacatatcttctttgtatcttaacttgtatcttctttgcccaggcccaggataaatcatttctccaatgatcccttttctttttagtgggaggtagtattagagatgaggaagtgcatgcaaaaggtttttatagctgctgagtgaatttgcttctcagtgtaagtttctagaccttgaaaatacaggtccagaatttatggattcaatattttcaaatcaattttcattaattttcttaatctctttgattttatagttacctttcttttacaatgaaatgtttgattcctaacagtaatataattatttacctttttctatcatataaaaactttcaaaacaaatatgagtatcattactacctaaaacattactaagtaaattactgactgtagtataaggttttttgtagttttctgtgcaccaaatgatagggtaacgaatagatgctatcttagcgtcctacggctgccataacaaattactgcacatttggtggcttacaataacagaaatgtgttctctcatagacctggagaccagaagtctgaaatcaggctgttgactgggccttgttccctcccaaggccctaaaggagatttcttcctttcctctctttccttctggtgtctctgggcattctttggcttgtggctgtgtaaatccaatctctgcctccatccttacctggccttctcctcgtctctgtgtcttttcttgtcttttataagaacagttactggatttagggcctacatggataatctgagatgatcacatcttgagatccttaacttcatggcatctgcaaacacccttttttccacaaatggttatactcactggtggttgggggaggaggttaggacatggccatatcttttgggggccaccattcaacccactacagacactaagatgtataatgattcacatagtaaggttttaatttacataatcaggttggatattgttggccattgggggtcaaattctacacaatcagggacccaggtgaggctattttcaacacacagcttccccttcaccctgggagtcatctctttccagtcaaagggagaaagaacatgcaaatgcacacctgggaagtctgtgggccaggcctggaattggcacatatcacctgcactcttacttgttgacaaggacctgcaaaaaaggatgagaaacggagactagctgagcacccacggggagaagaaaatgtttgttaaacaacgactgctagtctctgccacgattaccaattttgatagtcttatagttcatttgttttaggttgtattcagtattaaaacttgcccttatgtattcattaatttattcattgactaggcatttagttttataggtgagggaaaggaaagagtgaggtgagacatggagtgtggatctgagttttccttataagtcaaggaaaaggctccaaatggttggtagtaccaatttgtttgtcccgagttccagcaatgtaccagacaagaattggctgtgggacgaggttatttttcccacacctcagaagaaaaagaaaggcattttgtatctttgctactttctgcttgagatttcgaagggactcttcattttcttgagctctccaaacctgagaaaaggcactgaattaattgctgttgaaaagaagtcaagtttcttttcatttccttcctaaaagcagtttcctttcctttaagactcactccaggtctctgattctttgattctgaaacactggaaaagcaatcaaatagcagatgccaactctttgtatgttgagcttttggagttttggaaagttgggtctgaacctagaagtgaatttacattacgtctttcctcttctagaggtttcctttggcctatagctttcacatgggagagaaaaatgctggcctaccctacagagattggagtcaggggagagaaaaagggagaaaggtagtgaaaagaggagaggaaacaattatcccttttaaaaccatcctttttggtggcttgatagaaatactctgtcagaaatgctgtttggtattcgttgccagagctagacatcaagggcttagtctcgtttgaaatgtttaggctttagaaggagcaagataagtggggaaggaaaaaaaagaaaagaaacttttaggctgtattttgccaaaatgtatatcacagtgcctgccttcctgcctagcaatacaaatggaattatagatcccccactcccaccccaccttttaaaaatgacttaattgcctgagctggcttagactacgtggttgtcttgtttaaagtaaagtttatcatatgaatgacttttataaacttgaggacactgaggttgatctttgactatcttttagaaaatcattgctaagcaaattaaaatgatttattaaggcaggttagctaagaatttctaccaagtgatacagatactaccttatgtcattttaacatttgactatttaactcatactctttgtttgtagaaggctgttgttgctcacctttcacacacaaacacacacacacacagtcaaagggctttctagaagttgtacagcaagtgcttgagctgaaactaaaactgaagtctactgatgcctgattctgaaaaattttatgtttaaaaaagttttttgagaaaaccaccatacaattgtagcttctccaccatcaagcaattaaataattaacttcaccttgtgaagcgtgatgtgctagatgctaagaccaccacgcttcagaaaatattatgctgaatgtttcaaaacaaggttgaaaaaagatacatacacttaaaagtaaactgtaaaagactaaatatataatggaatgctcttagcccagatacatactgtttcctggttgcctacagtgttcttgatgaactttcaaggaaagaaagagtttaaaagaagtcattttctaaagtcattgaggaaattgaggtgtctacagtctttatccctgctgcagtagtaaaacaacatttatttaggtagcagaaatacaaggtaagttggtttaaatttctaatgatactgtaggtatttgggagtacagcaagactggaggaaaactaattagaaatatggtttgggttttgtaagaaacagctatacatagggcagagactgtgtatatcctccgtcaacatggcggatactagctgtggatgagtccaaggcttgtagcagcatcttcaggtactagaaatatccttatacagatgtttcttaccggtaaaaccactgttggttctcttcacaatcaattggaccacagccacttagttattgatatatgtacccatattttcagatagagtataacttcaagtcagtctaaaaccctataagatgagcacatctaacaggttaggtgtgtgcttatatatttttgtcctcagcaatgacccatttagagggacctcctttctactttccttctctgcctatccttagatcctatttgaaagtttggcttaatgattgattttgaccatgtgggtcacagattgaaactattgtttgcttaatcatgggatctgaagatgaaaagaaagaatgtggggctaatttgaaggggtgtttgtgtttattatgctaaatgtaaaatcaagatgtaagatctttttttttttcttgagacagagtgtcggtctgtcacccaggctggagtacagtggcacgatgtcggatcattgcaacctccccctcccaggttcaagtgattctcctgcctcctgcctcccgagtagctgggactacagccgcctgacaccacgcccagctaatttttgtatatttagtaaagacagggtttcaccatgttggccaggctgcttttgaactcctgacctcaagtgatcccagagtgctgggattacaggcgtgaactactgtacccagcctaagatataagatctaaggggaaggcatacagtgggatcactggagcctgggtttaagatgtaggtcttcatgttattagcacatgttgctttagtttttatgttttagaaggagaatatttatatatctaggagaatgggatgtggtttaggggtgagggtgaggtacagaagttggatcaagctagtgaattaagcaaatatgaaatgacagtgaagtcgtattaatggtttgtggtatggaggtacatttttagcctgactaaaaaattgtggtgcaattaccataatttttaattctttaaatagaattatgaatgatatgtttttgaaatagtaaaactaaggtttataggatcccttggagtactttatttcctgcaaaagtattaattgacaaagatgaatatttggcttgtctctggtgcatttcttcttcattagggcaagataaactttttcaagagagttgtgctcagtaacaaagtaaataaataatatctaaaattactttgatatactgtttttaattatttttattgaggtctaatttatatacaataatgttcaccagttgtgttttccaaagtggctagaccattttgcattcctaccagcgatgtaatagcgtccctgttgctccaaatccaatcaacccttggtattgtcagtccgttaaaattctagccatttttatgggcatatggcagtatcttactgtggttttaatttgcatttccctaatgactaatgatgttgagcatctttttatgtgcctgtttgacatttgtatatctttgttgaaggatctgctctgttcaaatcttttgcctattttaattttttttcttattttttttttttttgagatggagtcttactcttttgcccaggctggagtggagtggcatgatcttggctcattgcaacctccgtttcctgggttcaagcgattctcctgcctcagtctcccgagtagctgggattacaggcatgcaccaccatgcccagctaattttcgtatttttagtagagacagggtttcaccacgttggccaggctggtctcaaactcctgacctcaagtgatccacccgccttggcctcccaaagagctgggattacaggtgtgagccactgcgcctggcctcttttgcctatttttaaaaagtgggttatttgtcttagtgagctgcagaagttttaaacaatattctggatacaagtctttatcaaacagatactttgcaaatatttcattagtttttgtctcactttttagtatttataatagtattttctgaagaacaaaagtttttctgattaaattgaatttattttttaagtggctcttgcattttgtttcctaagaaattttttgtctaccttcaggtcacagagattatctcttatgttttcttctggaaattttacagttttggttcttatgttttagtctataatctattttgatatgtgggatgagttaagggtggagttgtactttttcctcatctgtctatctatcatctgtctgtctatccatccatccatgtatgcttctgtatttatctaactttacctccaactgtttcagcacaatttatttaatagactgctctttttttcatgaactaccttggtatctttgaaaaccaattggccataaacgtgtgggtctatttttgtgttctctattctgttctactcatctatatttttatccttacgccaatatgtctctggtttgattactgtcttgaaatcaggtagtgtcaattctccaactttttttttttttttttttttgctaaattattttggctattctagttcctttgcattttaatataaattttagaatcagcttgtcagtttctaagaaaaaaaaaccttccaggagtttggcagaagatgcactggctctgtagatcaatttcagtagaattgacatttatacaatattgactcttctgatctatgaacatggtactctattgatttaggtgtttttaatatcttgcaggaattttttgacatttctagtagtatacaggtcttacacatattttaaatttatctctaaatgtcatgattttgggtgctattttaagggatatatttttaaaatgtttccaattttttgttcctagaggaatattgtttttgaacaacctcccaccacttcatttatgcctttgtagagagagatggtttatgttatatcatcgtacttaccaaaacccagttttataattaaacactattttatggcttctgtaatagaaacaactgccttggataaaagttgaagttgagtgttttgagcttggttcttatgtttaaatctgtgcctaaattaaataaaagcaagtggtaagggtaggatgattaagatctgatgaatttctcttattttcaattattatgttcacaagcatgctttctttgcatgtatcagacccttcgcaccacttattgattttagtggaaagcagcttctttagctcctcccatgctacttgctttaaagtttcactgacaataaaaccgcctcagtgaatattccagttcagtttgattcagctagcacctattgaagttatgataattatacccacaatttgtacactgtttgaattgaggccaatggagtttcagataagccaattaatttaactgtagtcagaaaagcaattcttaaaatcggagcttgtaatttaaaaaaattcttgagtaattgaaaatattagtgctcttgaattgcctaatggtttctacaagaactcttaaggcttattttgtcttttttttttttttttttcctgatcagattttgaactctgttctctcccaacccctaatgttttatttgtatgatacatgaccatctctggggactctgaaagatcatctgtactttctttttgtttgaaaggcattcctaagtaagaggagtaggattaaagaaacctactcaatattacgtattagaaaatgagttataggatgttttggtcaggaaagactcattgaactagaataaattctcgctagtctaaataaaagaaagcatttggaaaagtctcatcagaggttattttcagtctgagagctgtaatggaacacttggaaagttgtcctttcctcttcaactagcaaaatgatttcatattcagagctgaagaatgttttgaggctctccaagaaactatggctgtggaatgaatctgtcgtgctgattttcaagtccagtctagcgcagaaatggccaactttaaaagttgggaacggaggaaagaggtacacagtattaatcatgcacgttttcactattcaagactccttgttgtctgtcctgtattcctaacctattatttgacatccactgtcgtttgttctgacttaccatttagatcctttgtgcaattttcataaactggattactagaactcagctaaacctcttgaagttactaccacatatccctcctttctctgcttttgttcccatgttcctgatctggaaaactcctctgtctcctgcctcttatactgtcccaggatatctgtgcactgcctgccttccaaaattcaattcaaaagccactttctccagggaggttcctttgatcatctcagttgggaagagcctcacctttctttgaactttgagaggatcacatatggctcttatcatattctactttgtattacaactatgtctgttgcatctcagagatgagatttaatactttgcaattgaatttatttctttttgtgctttttacagtgtcttctgtaatgtgttctggataggtgaaagagtaaaaagccttttttaaagttttcgtgttagtgcctggaaacaggggatccaaacatgttagtaagatttaaaatgttcagaggcaggggcttgtttagcaagatgttttcatccaataatgaccactgggatccctctaaatagtagcccagctggcactagcttcctctggtagtcattatacaaattagaatctcatctgaacttgccttcttggccatctattatagtcagtaggcagagacttaatactttttcattttctgtcaattgtcctctcctatctcaccatccccaacatgctcatacgcatactttctgtagatggggaagtccgccagctactctgaaatttcagaatttttattttgggggaaacaatgagcatgcattcttttggggactttggttctctcagttctttgggaatccaggtctatttgtgtaaatcattttttatttgtataaatggttagccctgggagggcaaggtgttagggcttacctcaggccctcctgtttagggatgctgattggtcttggcaaccctctcccctcttctagcccaccctgcaccacgcaggtgcactgttcttggcctcttccgtgttggataaatcatttctgtccatatacaatattattgcaacattttattttcatcttttcctctccctgttacttgtgtcagcattatctattttagagggtaaaacccttgaggatatgaattatgtctgtcagcttaactctgaagagtacttagcactaagctaaatcttacaaattagtacttactaatagcaatagtgctggttgtaatattggctcatttagagactgcagtttgcctactcagcctttggaaaggatgcccaactacttccagcttccaggaagaaaacattcaagtgtagtgacattatgtgaacaaaaacaacgccctttaaattgttactatctaaaatgaattattttaggatcaagataataaaacattaatactcacataatgatggtgacatctaattcatccctgaggatgttcaagcagtttatgtagctctgctaatacaccactgaaatagagccagtgactgtgtggctataccaaacgggagagaaactcaacagtgtgtgccctgagagccattcatcccctgagatttctattttcagatgtcatgttataatttctttccttaagcctcagaatatgaaggtataagataaactggaatggaattcttgtttgattgtgtatccaaatgtgatttatggagcggaaatgcttataacatgcttgttctgagtctagctcacaccaaattaaccccaattaatttctcatgtaattggatagagaggatgtaaaagatcagaaatgctaagctagatgagtggaatgtccaaatttcaaacctttacacagaaaggctttcaatgacaaactctattagatttaagtggagaaagaggaggaggacatgtagggagaggacgaaccaaagaaacagttcagcttgttagaaagaacttaagtctgcctgcctgtgtctagtagaaaaggctatgttgtagcatagctgatgaattctgtttgctgtgacttacctaattaatttactacacccctgtcacagcccgtcacttagttcttttcacaatggtctagtttcccaccttgggttgcagtagacttggtcattaagtggagtccaataagtgttttgttttttccttgtctgcaaggcaggtatgtgtataggcagcctaacgttccaggcaaccagtagggaaagaggaagctaacatacgccttaggggattgggttaatgaggaaacgtatggttatgaaaggcattagacggctttagatctacgagagacacagctgcggctcatcagcaaatgttctttggctctgacgtgagcttgactaacttatgtctactgaacctgctggggtacatcctgtagagtgtgcttatagtctctttgtttacttttacatttaaaagttacccttaatttatgaaagaagtgacttgtatgtgacatttttaaaaagtttaattctttgaacattgttgaagatcaactgtgtgccaagtattcttttacatactgggactcaatgaagaatagaacatgtttccaccctttaaaaaatgtttatactattaaattcaagatgagcatgcttattatagtgtagtaaaatgaacaagcatcagaaaaagtcagaaaactgtgtttgaacaacagaaacattgggaaaatacatcagagaccttacacatacacacacacacacacagtatatgatttcaggtaagtcatttaatctttaagcctcagttccctcatctgcaaaatggagataatatctacttgccagatatagaagcttgagtgagctaagaggtctaaagaatgtgataaactgtgaagtatcactgaaagataagttaaaaatcagagaaacaaaaagtactgccccacatgaaaagttaattgtatttgaaatatctcactaaaagatatttgaagaatcatctacatgatggattgcacgtagctgctaaaggcaaggagttacgaattacattacttctaaattaaccagttcagggaagaggaagaggaggattaaaattcattatctggaatattttatatgaggttttttttttttgtttgtttgttttttgagatggagactctgtcgcccagactggactgcagtggcatgatctcagttcactgcaagccccacctcctgggttcaagtaatcctcctgtctcagcctcccaagtagctgggattacaggcacgcgccaccacgcctgactaatttttgtatttttagtagaggtggggtttcaccacgttggccaggctggtctcaatctcctgaccacaggtgatccacctgcctcagcctcccaaagtgctgggattacaggcgtgagccactgcacccagctgtatttttatgagttcttaaataaaactcatataaaactttcatgggaaccatgaaagaaggagagagggagagggagaagagaaaagaaaactcggcctacatccagggacccaaataaaagtgttatggaggaagaatacaaagccccaactgtttttgtaaaacttggggttgcctgtctaatatctaaaggaaccactgtttgagttataaattcagcacctgatttgccaaaccttttctctctgtttcaatgtggccaatttgaacaacagaaacattgggaaaatacataagaaaatttcagcaccttgccaaacacatttattttgaaggacttcagatggattatgggcatcctatttatttgaattaatatatttttccctctaaatattagaattttagatattgtattaaaagtcgaaactgctttggttggcagtcttccattacccacacttttaaaactgcttcatatcccatgttattttcaggacctcgttgcctgcttgcttgacatcaatgatataagtacctttattaagttaccaacttgagttgcactgtgtagaaatgttattctttagtcatgatgagctatcaaaatgaattgaaaaggcacctccaaagtcttggtgatcttgctccttttgatagttaccacccctccattgagattcccagcttttctgttcattttgatcctcttgcaaaaagcactcaaaattggcagcttccatgactccatcttctagagggtgggtggaatcaagagtgaacttcagaaccttctttttctgtcttccttctccccatttgccacaagctttttcacgggttccatggcagcagtggaggtagaaagaggagatgggcagactatgccaaggcaaatggccccacctgagttttcttagaagtggatgcaatgtggaccaactgtgttttaaagcatgaggcttccttattttctctttcttaatacatcagtaagctgctcaaacaaatgaagaatatgtggaatacaacgacaaatgctaaataagcatatttgaaaaagtgtgagtttattacatgtagaccttgttcataatttcaagtcctaaggaaatatagtccagtcaacaggaccagcaaatgtatgtatttgagtaagccttctgagtcgccacagtcccaaataggaaatgaaaaaaagctgcctttactgactgtcaaagatagggctcactaaatgagtgaatgctactgcgttacatgtgctactccaccaaattttattattgtaaaaataaaattgagcccaggagttcaataccagcctgggcaacatggtgagaccttgtctttagaaaattagctgggcgtggttgcctgcacctatagatccaacttcttaggaggtggaattaggaggattgcttgaacctgggaagtcgaggctgcagtgagctgtgattgtgccactgcattccagcctgggtgacagagtgagactctctcaaaaaaattttttttgaataattggaattatattatttaaaaggataatatttatttatattctgatatgtgtttggcatcagctgttgtcatacatgaggttggaaataatgactggcttctagatagctcatcagttcatttttctgagcttcttgtgattattttagccctcagctggactactgctaaatccccatggcaataggatcccctctgattccttggtgaggtgatggtgatttaaaaaaagtagtttatacacagacacagtgatggcactagagatgttgaatagttgtgattacttagaaattgctctcgagatagaacatttgaaggaataattagaaaaagtgtgctgttctttttttaaaagcagcttgattgagatagagttcatatactacaaaattcaccctgattatttttaaataaagggaaaatattaataggtgtcctactacaaaccattccccctattttcaaggataaacaataacaaatatagattttaaataataagattatctcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacacgtatacatatgtaactaacctgcacaatgtgcacatgtaccctaaaacttaaagtataattaaaaattaataataataataagattatcttttcagtattattacagtggcctttagcattttaaaatctacaagcaagcaaggcttcagtggaccatgcagaatgttgtggttccctgtgttggagaaatacaagtttctatgggataaacaaatgcatgcacatgctggccaattgtcagagtgaaataccaaaaaattccgttgtggagtaagtgataatcagattataaagaattaaagtaagaaaataccttttgggttgtacgtagaaaagaacatgataaagattatcctcatttctttttttcttttcttttcttttttttgttttagacagggtctcgctctgttacccaggctggagtgcagtggcacgatcagggctcactgcagccttaacctcccaggctcaggtggttcttccacctcagtctcctggatagctgggactacaggcatgtgccaccacacccagctaattttttgtattttttgtagagatggggtttcaccatgttacccaggcttgtcctcatttcttgatgaatctttatttttcctttagagctgatttaaacttttttttgtgagaaatatagcatctatatagaaaaggtagttaagcccgagaaccagcatagtaagtagtataaagccagcacctttgtaactgctactcagatcaagaaatagaactgctggcctcttaggaatgtgccatatttccccctttgattatgactttccccacttcagtcctccaaccatgactttcaggctgatcatctccaagtacgcatatatacacacaatataaaaccatatatctatatgtatagtgttaccccttgagtgtgtatctgtaaccattaaagtttaatgtcacctattttataagtgtgaagaaatgaaatcaggtgttcttcttggctcagcatcaggtttgtgagatccattcataggagcatgcagtacatggcttgttttcattgtaatctagtataccattgtatgaacgtaaatataagtactggttcattttatggtttgtggacatgtggcttctacccaggtttttactgttgcctgttctgctttggacattagggtctataaaacctgatacacgtggcatgaatttttcaaagtatggttcctcttttggcagcattagcataaaacgtgttagaaatgttgattcttgggccccacctctgacctacattcagatatcaccttggactgtatattgtgtatgtttatgcttattccagtgactgcctttgctcaggatacttttggatcttccaggttggaatccattcatgtcggcacacacatgtgtacccatgcaaacataacactcccacattccagcaattgactcgttgctcatatttgaaaaaaattagctttatcagtttgagtcaaatcttttgttattttcaaagataaaataaatatccaaaagagaaagatttgccaacattgaagatattcaaaagaatatgcaaaagattgaagacctgctgaaggaggacctgaaacaggttgggcaaaacaccattcctagaatggaagctgcagggccctacagagaaagcagtactgactctggagttgagcagatgtgggttcaaacccacatgtacatgtgaccagcagtgtcatcaaagagagttctgcatttctctgagcttcagttttcctcctatgcaaagaggggatcacatctactaccaagatgcaaaacagttagtacaaaatgactgctcgcagggccacatttatactgtggatgcattttggtcatattttggtaacataatctgatgtggctgactgtgtcatggcttcatacctttcatgctttggacttttgtgctttctgcaggaacgattccaggtgaagaatcctccccatacatacattcaaaagctcaaaggctatctggatccagctgtaaccaggaaggtaagatggatttgtttccactctttgttattgcttccttattagcgagcagaatcctcctgcattggaagagaccttccttcctctgcattagagcctctgccagagcctccacaaaaaacaaccttgggagaccaacaacgtaagaagacaaaggaaaaaaaacaaccttctcacttgaagatgtgtataaaagttctttcctgacatgagagtcacgtacctctgatggttgttgagtcactgctatttccaattacgtagggcagtgagtgcattccagaggtattcaggcccctagaagagcaggctttgcaaagggaatacttgcctttcagttttttatgccttggtgcatttccagagaccttgaaaaatcactgggcctttgtcatcccagctgtgcactcacatcctgtgttgatgcttttagcagctcccccctactccccccaacccctgcccctggcctgagaaggtaagtagagaatagctgattccattctcaacagactctccccttttacaaacaagccctgctttgtgcagccacacaattggtttaaactgatgcctcgtggtaaagcatgtagcctggcacggccctgtgggcctgaatcagtcctgggatgtctcagggcagagctgtccttgctcaagatgggtgaaggggtgctttaccagatagcatttgtttttccattgacctacaactcctgcttttaaggctcctgcgaaaatctctcaggctgattctctctgttgtttcagtgtgtgattcttgagaaaagaatggtatactttacctagttagccattttcagggctcttgatgcttgcattaaaaaaaaaatctttttctttatcttctactctaactcttcctcccctcaccgcccaccccccgaccaaaaaaaaaaaaaaaaaaaagtccagcaaaggagaacagctattatttccttttggaagtttcctaggcctttctcttacggttaatatgtagacaaggggaaataaaatctagtagtgatgatgacagtgtagtgcagaacttcatcactggctgtatgtcatatgtgacttgaatgtgacacaaccttcaatccaggaacgtacctgtcaaagtatcatgatacttctcccctcgtaaatgtggcacacacatttctttctaaaagacctgttgtcaggtcttacacctgcaaatgagactattgttcagttcttgttaacttctctcatttctccctttccctaagaatgtggcagtcttaatttcatcatttaaagaggtctgtaaaggaggatacacccaggcctggcacagtggctcacgtctgtaatcccagcactttgggaagctaaggtgggtggatcacctgaggtcaggagttcaagaccaacatggtgaaaccctgtctctactaaaactacaaaaatgagccaggcatggtggcaggcacctgtaatcccagctactcgggaggctgaggtaggagaatcgcttgaacccaggaggcggaggttgcagtgagctgagattgtgccattgcactccagcctgggcaaaaagagcaaaaaactgtgtctcaaaaagaaaaataaataaataaatacagacacacccatatacacaaaatacatccccagacaggtgtttttctgcactatttctttgcaaagggacagcaagattctgttttagaatcgatttctaaaggttttctgaaatctccaaacttgtaaccttcaggctagatggctcagacctcagcattgagtcctaatgctcaccctgagttgagtgtggcagagatgctgatgtttatacagaagactgagacctttcctcatgcagaattcatcctacctccaaaaaattccttccacatttttccagttctgaatagaaaggaaaaaatatgcacactcctagggagtgctgcttaggcccccacttccataccccacatggaggaagatgcttagaaggaagaggtgggcttcctcctggcacagttccaattttcctttagatcagctgtttctgggtttaggcaaagagaacaaagtgaaacaaaacaacagataagcttcccagaaaatgttttgcttcctcacaaataataaactggagcaggacataagatgtctgtttgggccttcattcccgacatttctgccctggcccatgtgcgttcacctgaatggccatgtttggtctgtgcttcatctttcaagatcagtcattcagctcagaaaaaataaaatggatggtggattaaccacccctgctttagtaagattctgtcaggagctggcaggaggaaatgatctgttccacacaacataattgtaatgcttaaagcctggaaaaaaaggagatttgttgaaataagacatggcttgcagttaaaatgagcttaaaattctcagctgtattatggtgggggagaaaaagatttcaattcggggctttaaatttcagccagacagtctaggttgggcagttttcctttaactgtgtctggagtcctcgaatacttgattcgttaatcttttgtgcaaattgaatagaagatacttaatttgctttttttaaaaaaaaattttaagcattttctatttagattttcttctaaatagttttaaatgaaacctctcgggcagaaaaggaagagcctaaattagatatctctatgaacagaactctccaaaccagcctccttatttaataccaggaagtgattagtctgtgtttaaaggattctggtcctttgctggcgctgcagttgtgagatgaaacctattgtagggctcatcctgggctcagctgcctctgggggctcatcccaggcctcccttgatggggagggaagggagaatagtacagactgctcatggatcctctgtggctccccatgggcacataatttcttttcatagtgttttgcattctggatagattttagaagtgcaaagtgttagcactcattgtgtatatattagagaagtggactccaagacttctctgtggcccagaatctagccgaaaattgagccgttccttagataatgtaatacaggagtaaagtcagtttagtttgcctccgttatcaggcagttgcagaagggtagtgcctaggtagcatagtcagtgcccaaaaacagcgctgctgctgttattattacctcatcgtgttttgatttagttacctggtttcgatacatagctcttagtccttcagtggaccctcttttatactctgctatgtcctcagtgctacgctgggtgcccttgtgcctgatggcatacgtaagggatgaccttgccccgaggaagcagaaggcggcattaggggctgggtgttagttcctttgtgttgctataaagaaatacttaaggctaggtaatttatgaggaaaacaggtttattttggcctacagttctttaggctgtacaggaagtgtggtgctggcatttgcttctagtgagggcctcggggtttacaatcatggcggaaggctaagggggagcgggtgtgtcacatggtgagcaagagggaggaggtaccagcctctcttaaacagccagatctcacaggaactcttaggagtaagaagccacttattatcacgaggacagcaccaagcagttcaggcgctatctgcccccatgacccaaatacctcccactaggcccacctccaacattggaggtcctatttcaacgtgggatttggaagggacaaatatccaaagtatatcaggggcccagcagaagcaaaggctgcagggaatgagtcagaagtgcacataacacagagcttggaaggctgagttattttctgacaaccacctgtgcaggcagcccgagacttaggactctgacacgggagtggccacactgagcagccagcatatctggaaatggttgccttagctgtgtgaccagagaccctagaattttttgtctcctttctcttcccttctctatatacacagcagactgcctgctccattctactgactctcctctactctattcctaatttttagctccaaggaagagtttaaagagagagaatacctttagctgcccatcctgcattacttgcccccattctttttttttttttttttgagatggagtctcgctctgtcaccccggatggagtgcagtggcccgatttcggcttgctgcaaccgctgcctcccaggtgcaaacagttctcgtgcctcagcttcctgagtagctgggattacaggcttgtgctaccatgcctaatttttgtactttttagtagtgacagagtttctccatgttggccaagctggtcctgaactcctgacctcaggtgatccacccaccttggcctctcaaagtgctgggattacaggcgtgagccactgagcttggccattactcccttttcaagccaagtactgtgccgagcctcctcattgctgggaagtggtctagggagctctggggttgggtgtcctccaaactctcaagtatgccaccatttgttaggcctgtttcgacagaagaggggagtgcctctcttttttccatcacattggggacatttttatttcctacttcttactatacctggattctggaaacctgacatggtctttttagattgtcttgggaatggcatttatggaggaactgtgagaccatctgcttccttgggggctctgcttagaagcagctggtggggaagccaggggctttcagaagaagatgacagggtaacaggagcctgctgtgctgagccgtgcttcaggccttcatgggccaccaagtcccaggtgtgggcgtagctcttgccaccccacattctggaatccttacttccatcctccttccttttcttcttgtccttggagctgaaggactctgtgtctgctgcaattgtggcagcagaggagagaggtcctttatatcctgagccagaattctcaaagctctttcctgtaaacagtgtgacataaaggtggttcaggttcgtagcacagatagtctggaactccgcttaggaggcgctgacatcaagttttcttccttcaaagtggcctgagactgtcactttatatttctgtaggaaaatgtgttccaaaggactgatgtgcaatgtagcccattgatatcttggaaatgatttagggtcaagaggctagagaggtgtatattaacacatttactatcagaggtggattcagtgaagaaagaagccccgagggattcctggaagggtaggtgggattttaacaggcaagggaatgaggaagggcagttcatgtcaggagggtggtgtgctctggaggaaggaccctctaagtgaggaataaggggcagaggtagctctgcatgcttatttttgcaacgtgttaggtcacgcagaaaaaaaattaacatagcaggcctgagactgctatgcttagcaaagggcctgcctgcaaggttggcccttggctggcatctaggaacttgtgtttgacgggggaaagttcctaccatttcctgataagactgtttcgctgtgcctaaacagtttatgaaaacaatacggcttatgctgaatgcctcttttccctctgggagtctgaatttgtgtaatgtactaggcagagagttgcctattaaaccagctcccaataagaacctggccactgagtctctaatgagctttatgcatgttgtcatttgtgtctcctcggggagaggactcctggaagattgcacctggtttcctgcacgttttatcctatgcaccttttctctttgctgatcttgctttgtattcttttactgtaatacatcatagccacgggtatgactgtatgctgagtcctttgagtgctcctaatgaatcattgaaactggaggtagtactggggtccctgacccataggaatattggtgaatactgttgtgtgtgtggggtagggaaataaaatctacttactgaaaggcacattacataaaacaaggactttttgtagtcctttctcagtagttaattttcatggtgaggaaaatttgtgtgctctgcaacaaaaaaagtgagggaagcccattttagaagtgaagatatttttcatattgtgttaaatttattataactaagcttcagttatagcagttgctaaaatattttgtgagaatatgtgttcttgaattatagaaattcagacggcgtgttcaagaatctacacaagtgctaagagaactggaaatttctttgagaactaaccacattgggtaagtatacccctttaacatcttagctctaaagcttttggacactttacaaagtaactgaatcatacccaaagaattgagcttccttatgggccattataaattaaaagactgaggttttagtagatgaaaccttgttagtactcaaattacttactgcccaagaatcagcagaagcaagacagatagtccttgatgtggaatttataacaattctatatttctttgagcgggtgcagtaaatatggacacttggtttcatgtgtgcataacaattctctggcaaatcagaaacccccaatagtgcatgtagactgagatcttggaaaatctctaagcttttactgtagttctccaagttggttggttgaagctgctttatttccctttcgttaattctctagagtttctggccagaaggggacggaagctggaataatgtcacttgactcacctcattgcactcagacacattctcagtctctttttcatacatctcaaaacctcaggaccatgaagtgtaaatccactgtgggaaaataaagttcagggaatctatgcactaagcattctgagtttctttcagacaatgacatggtgctttgcctcaggcaagaacagcaatattatattctcccttacccctgggtggcctaattgtactatgtcttaaaacaagatggcttctctctaaggtagaatgatatcaggtatcctattttgtagccctccttctgcccaaagcacctgcgtaacattgggcaagctatttaacccctttggttttgattctttgagctttacaatgagaggactatcgacttttagatcttttagaattttcccatgacattctttgcaagtctattggaaattaattttgatgtatatatattgcactttagttttacagagtatgctgtaacatacagtaagttctgtctcgttgatagttcttcttgaaaaccatgagtttaagtgaaataatgttgttataaaaccttttccccccctcatcaatgtcataatgaaataatgttatttgaggttaagtaaggacttgatgtggatttattatgtagataaaagtttacttcagactgctgtaagccattcaaatggttaattagcatagttatttcaaaataaacttttagaaactgtagaaatgctattgtgattgataggtgatggaacttgggtaagaatgtgcatttcttaaatgataaccagcaggtttttcaccttgagaatgaaatattcagaaaatgaattaattctagactttgtccctggaaatgggctatagaacaaagaatcatagagtcatgattttagaactggaagagaaattaagaattgcctgatgcctacttttacagattaaaagaattaaagaccagagaaggtgagtgaattgcacaaagtctacagctgtagagccaggtgctttggctcaagttgctctgttgtttttcctgtatgacttatgctggcagccgtttccctgaaagtaaataagattatcagggatctgggatcaaagcaatgaggcttgtctgctggggatgaacatggtagtagtttaatacttttgggcatttagactcagcacatttaaatactttctaatatttatgaatcaggagctagattcgattttgtttggtccaaacctttgcctttggcccttttaactgaaaatggtggaatgaactgcagccaagatttctacaaattgtcaaaaagcatttcttaggctgtgcgtggtggttcacgtctgtaatcctagcactttgagaggctgaggtgggtggatcacctgaggtcaggagttcgacaccagcctggccaacatggtgaaaccccatctctactaaaaatacaaaaaattagccaggcatggtggtgcgtgcttgtagtcccagctgcttgggaggctgaggcaggagaatcacttgaacctgggaggtggaagttgcaagtgagccgagatcattccactgcactccagcctgggtgacagaacaagactccatctcaccgaaaaaaaaaaaaaaaagcatttctttaagcattgccgaagtaatgtgaaattgaccatcaaatacaaaaggaagatgatcatttccaacacaaacttggctgaatagaagaaccttggttgggttgaagccagtgcagtctgcaagcaattggagtggtttgttgttgaggatactataggcatattgaaagattcttagatttctttcatccttaccaggtgaagttttcccttgcccaccatctatgtgaggaactctgaaagctttggctttagcagcagaaaaattcatggagatgcattgtctgattatatgcaaccaatcactagcataaacttacgtgaagtaaaaccacacaaccagattgtgaccatcttgcctgttctgaaaacccaaacctgaactcactctttgttatgtaaactaactggcttgctctcacttgatagggatatcttctgaaaaattactcaataatgatgaaaataatcagttactaaaatgaagaattcttggaatgcaaggtgctatttaaggaagccatatattttattgtactgtttaaaatactgtaatagatagataattcagtgagtgtggtgacccacgcctgtattcccagtactttgggaggccgaggcaggacgattacttgagcccaagagtttgagaccagcttgggtaacatagtgagaccttgtgtctacaaaaaaataaaatattagccagtcacaatgtcacgtacctgtaatgcctgggacactgaggcagaaggatcaattgagcccatgagttcgaggctgcagtgagcagccattgcactctctgagtaacagagtgagaccctgtctctaaaaataaaaaatcggtgcccatttgctcaaatttttgctatgcccctttctagttatttgaccttagataagttatgtaagttttctgcacttactatgtgacccaagttaaattctcattgataaaattagtataatacttacatcacaggaatattataaggattagatgacataacttgtaaattcctaataaagggtctgaaacataatagttactcaatatatgatagttgtttgttatgcttgttgcaaataattacctgcagtattcaacagtattatatatctctaaggatatacatctcttatatatatctctaaggaattccctaaggcagagagtattatcatctttatctaaaatgatcctgacacccaggagattatgatacccagaaattaaaaaggagggattacatttacaatctacttgtcctaaaaaaattgttctgggcacatgcttgcttttcaacgttaaagacttgagctttcccaagataacattctgagctgcagctttgtcaagcaaaggacttcttctgagttttgatataagcctaaaactctataaatggaacaatcttctgagaaagaaaattaattttctttgagtcaaattgaaataagaattggactagaaataatcccattcacttactcttaggaactataataatagagaagaattggattatgacttatctaagcttttgaaattacttgaaatacccttgaaatgatccacatagtgttagaatacactagccatgcagtgtgagtaggcagatgccatggtgcttaagatgtcagagtgataggatttaaatggtggtgagggtgaactggacagatttaccagctttattctatggaactgatgtgtacactgtctctccttgcagggaatttattgtagtaaagctacctataatgatagaaaattacttttcatcctcagtgcaaggtcacagaagttctgaaagatgctcatttcactttctcattgtggtgtagagagaacaggcatgagatggcagaaggaatgtggcaagttggcaaggaggggaaggaggtttgtagaaaagggaagatgctgaggaactgcttagttgatgtcttctctcctgcccaccagacttctttatgaatcagtgctggctgagccaggccaaaagaagaaagacaggagagtgacaaaggctgcttttaacatgcatacaacacgtatgggagtgtatgtgtgtatcaagctgccttatgattaacttattcctagatggtacttttttagaaaccatcaaggttataatcattttgtcatttattaagcacggtgttaggtactttacgtttgttattctgtgtatttcctacaaaaatcttattgaccattagccctgaatccctgttttatggatgagaatactgagggtcatttattaagtaccttgctcaattccacacaagttagaagcaccgagatttgagcctagatacggtcacttctaaaatttattactaaaccagcaattctcacattttttttttttttttggttttagagtgcctttatacttttaacttatttttgaaccccaataagcttttgtttagatgtgtcaaatctattaatgtttataatattagaaattaaaactgataaattttaaatgtctttaataaaatgtaatatttaataacatttaatttaaatacatataaaataaatgttatgtattaacataaatattaatacattataaattaaatgacatgttttatgaaaaatattcttcaaatccaaaaaaaaattggtgacaaaggctgcattggtttaatttttgcaaatctccttagcatctggttaatagttggcagctagattctcctgagtcaacattcaatttgtcgtgatctgttttgattgatgtatatgtagaaaattgggtcttatacacacttagagatgagttttttaaatggtcttttcagataattgggatattctttttttagtagtacccccaaaattgaacggctagtaactaattcttacagatagctataatgtagagtctgaaatcatatcagtgaactttttgtgctctgttatattaaaatccattggccaggtgctgtggcctgcagtcccagcaactttggaaggccaaggtgggcaggatggcttgagcctgggagtttgagaccagcctgggtaacatggtgaacccctgtctctataaaaaatacaaaaattaaccaggtgtggtggcatgatcctggagtcccagctactcaggaggctgaggtaggaggatcacttgagcccaggaggttgaggctacagtaagccatgattgtgccactgcacttcagcctcagcaacaaagtaagaccctgtctcaaaaaatcctttgtgctgtcttacactttgattgggtctttttatccatacatgaacttgtgacatgatttgttaacatcatgttggtcatttggaagatcagaataactcagtaaaatcatgtttctccactgttgaagcatatccctttacaatgtttttaaaaatcacatttgttaataaccaccagtctgattagaatatatgttaagtattgagaagctgtcaaactgacggtggtgaatacaggttttccagaattctagtttttgtttgaaagctcaaagttggtcatcagcaacaaatactgtgttgtccttgaaaggatgggctcacttcatatttgagtaaatgtctgccacataccccaaactgaatcaccatagtttgtcagttatttttacaagtaaattgacattccatgaaaaaatggctagttcagctcgcaactcaaacaatttcacaggtgcttttccttgagacaactgtgctacttgagcaggtagcagaagtactttatgtgagcttcctgttttgtcacactgaaaatgaaaaagatgtgtactaaatgagtaagctttaataaaatcaatattttttattgcttatctaagggcgttcttaagtgaagctggccttttccccctcctgagtgcacggagtgacaaatacaataaataagtgtcttctttggttgcagcagttttatacagtatttctttggcattgtaagtgtcagtgtcaacagattgaaaacaactaatgtcctaatatttttgtgaaaacagttttaccttcacaggcgccctgagagggtttcagggacccctagtggtatatgggctatactttgagaatcagtttgcaacactgcctaacagagtagatctgatgaccagtgttgaatccacacagtgcttctttctcttgcttttcatgatttttcatcaacttcagttcccaacatatgtctgtaggacctctctctagaggaggctggcaaaaggaattaactgctttttcctttctgttgtgcaactttgggctacttggcttgatcttagaaattgaaagccaggaacatctcttaagacctatatgaggagaaataaggttctaagatttggggagacagaacaaagatttgatattaagctgtgaccagcctacaataaaacagtgactgttggcattggcacttacatctcttccttgcacccaatttcttccagagctatttgtcattgtccctgtcttttccagctcctaagcatctgatttagaatttgcctaaattcagatgtacagcatatggtaattacattgaatccgtgaggcactcaggaagttatgcgttctgtcagagtcagaaataattcaactttccaaaacctataatcacccaatttgaaactgtttgcctattggcaacatattaaaaagtgtgtgtagcatgcacagaggtgaaatggaactaatttgctatgggaaccctgaatatatgatatagtccttgcatgatcatttacataaatctgcaaaatgaggcatccatattctttgaatgcctttagattccagttactgctttgaaagttgcccgtttttatctttacctgttttctttccttactcttatatttctgtagaagttcactttcaactccaattgaaaatggccagttctctccaatacagaaagttccaagtcaagaaggggtagggactgagataatagttagaaaaatgggggctcttttttcatgtcatccatacccttattgctgaaatgactttgctaagctaacctgataccatttgataaagtggggaaggtagccagccctgaaagactgatctcattctttcctaaagcagctgggggtgtcaggactagatcaaatcccagggaggatcttgtagctttgaaaaagatgttaactgcatgaaattaaatcaggggtaaaacatgtcacactttagctgaccttttaggaggtaggcagcaggctgttaccttttactcagaaaattgtctttgaggccctttcactcaaagtcaggaagtggtgatgggggcatggataaggactctgaagtgaagtaagaggagccaatgagtattctttatccctgcattaaaacgtatgcatattagcatgttaagcgaattgtaactctggctgtacttggctatttcctaccttaaaaaaatttagtttttcttctgtaggtcacttgcctcttgtccaattggtggctgaactttccaagtgagatggaggtgcctgccagtagttgacacaagggcaggcactgagtgcattctgaatggtctgcactctacagaggctgcatctggaaaatcaaccagaagaaacgacaatggctgtttctcttagctcctaaattagtgtgttcttatgggccactgagaatatgtacaactgagactgccctgaaaaatctgcccccctccccccgccgtgattatttttcatattaaaaagacacccaccaccgagggccagtttaaattgtacaatcacagcccataggccaccaatggaaaagcctaagcaaggctaaggggcttgaatttaaagattttctaatcatcagattttgatattgagttccagactttaagtctccagccagttacaaaaaagaaaaaattctttttactatttctaagcttctaattactagtatttaaacgtgatcagtgtctcctgagacctagcaccacagaaagtacttaaaataaataaaaaataagtatctagtaggtgctgtgagattgtgtatgtggctgttttgaaatgaaacttcagcctccaccagtagccagccctgttagttttgtctaggtctcataacaaagccactttgtgaggcctaccaggtggtattttctttgccaccgttgccactccaggtctctcttaaattaaatgttatatgtttacaggcagctatgccaagtgcataggttttgcagttgcctctctgaggcgcttgaggggaaaacacaaggcaatctttccactttcccactttgccgcctcctggaactacctgcagacctgggctgggtttgcatcatggagatgacaggactagaagaaagaatgaccttgaggatgaaacaaagaaccccttccccctgccaaaaattaaaacaaacaaacaaaaaaccaaatatcctgattccatgggattgttttctgccttttaagacaaagacctcaaggggttgctcatgcttaagggatacttggtagaattgtcctactgttattttaataactaacaaaactggcttccatagtcactatcatgtccatagctggtcagactttttagcttggtgtttctggaggaaagcaaccattgtggaatgcaggtggcagatgtacctcaagtggcatttcagcgatagtagtagatcttttaacttattatttgttggagtttgaaacttagtgaaggtttaatcaggtaccatatgttgtttgaagatgaatgcactggaggaaatctgtaaaagggggtggtgacattttacatccatctccctaaagattctgtttgacctcccatcaggattattatgaagaacaaataagaatgtataagcattctccatgcactgtggagcaccattcaaatgcaaggaggtattatttaaaaatgaattttttaaaaaacctgatatttgtcatgtgccggccttgatgatagtatgcggtgcctgcagctttttaaaaaggttttaacattcatggaaaaagttaagcaaatcattatccctattgaatttctagaagcccataaacagtggtctctcattggctagtttagtggtttctgtagcttagtgtgccaaggacttgaacttggatttggaatcccgcctggatttttgtggttatgttgtcatgtcccccatctgcctcattgtccatagtcttgcttccttccacaagcaggctgtagatcaattgtggtggaaaaagtacattaagcaagtgccttctttaaagaaagtttcttacagattatcttaaatcctctaagcagtaaaatgcaaagatggcccacgtgtactttttggcccttatttttgcacattaaaaagttgtggttttcttagttaccatatctgaaaagctcctgcctcatgtgaagtagtctaggccttcctccctatgtcctttcaggcaatgaaagtttctggtggaaaaaacaaaactttgcattgtgtccgttccatggcaggtcatgtgatcaatttctccaatgatttttttttttttttccccaacagatgggtcagagaatttctgaatgaagaaaacaaaggtcttgatgttctagtggaatatctctcatttgcacagtacgcggtaacgtaagtaaaacttggcttgcttgcatttgaattttatgtggtcacagcagatgctactcagtggtaaaattatacaccacagagagggcagaaactcagaagcagatgtgctagggcttagggaggtttgtttctgtttgggtaactaaaaacaaatcacataatggtattagaaatgcctttaaggcagaagtaaaacaggtgaataaaaatcactcttaaaggagcccttattttcaaaagtaacgctttctttagggcttaagttacatatatggaagaatagtctaacagttggtgaaagaggtatgtgataaatcactaggcgatgcaaaagagtgactccctttttcttttaaaaatgatgtctgcatgtatatttgcatatgctagtaagtgcatagaaaatgattgcagaaacagataccaaacgtagtggcactggagggagaggtaacaggaggctgttcctttttccttgatatgcatttgtattgttttgattttctgcccataagctgaaggggagtaaaaactggagtgcagtggcatgatctcggctcactgcaacctctgatcaagtgattctcctgcctcagcctcctgagaagctgggattacaggcacccaccaccatgcccggctaatttttgtattttcagtagagacggggtttcaccatgttgggcaagctgctctcgaactcctgacttcagatgatccacccgcctcggcctccccaaagtgttgggatttcaggtgtgagccaccgcacccaacctagaagcactcatttctatgtgtgtttcctttttctgctgtgtgagagtgaggatgagctgagaggaacacacgctgaatggcgtgggagctgtagagtagcctagcgagggcatcaatgccacgagtgatttcaggatgccctcctcgtcttaccttctctcatctcagtgattgctttctctttttagcagttaaaattttattagattaccccattctaactcttttatgttcagtattacctcctgcagccaaaggcatgacagaattgtgaccagttgcctccatggactttgtgcatctatctctgctatctgattagtcttttataggtgaaagtcatcaccaattttcagatgaaggttctaaccaaatattttattttggcagttatacttttataaaaagttacactttgatttccaatatgtattattgttttttcttctgcagtatcctctaagattttcctgaggatattaagtgtagctaccttctgattgttctactgtctgatcaggtgttgctatggatagaaacaattaatacaatttcttttttttttttttcttttgagaaagcacagttactttgtgaggggggaaatgcatggagcacaaaagcctgtctgtttaaaaactttgttcctaaaactatacaagagtgagcaagttaacttgtcatttattctaacatggttaacatgagtaataacctcaaaaaatgtcagagaaacaacagtcttactttaaagagcaccacactgggaggagattccaaaatcaaagcaaatccataactttgctagtaatgtatcacatatgcttggaaaagtacacttgccaacacactaggagaaaatgctcagtgaaaattgatgggtaggaataaattagtataagcctaacatattgacttgttaaagcaaaatgaagacagctgtaagatcttttcccccttccatcataccaatgttagtgacttatatattagcaagccttataaaataaaatacaaataatatatcactatttaatttttgctgctcattgttccattattcttttgccagacccattatttgtcattctgtattcttaaagctaacactgagcccatagaaattccattatatttcctttccagttttctttgtttacaaagactttccatactaaggtgcagatgtcttgtaggaacagcaagttatacatgttcgtttatacatgtgaatgtgaatttttcagtcttcaatggcatttctcttttgttttagttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcggtgagttcgtttaatcaggaggcaactttggcaggatgcactgggacagcaggctcctacttcttttgatgattctgggcactgtatctcataaattgccatacagcactttcatttgcaatgactctaaatgaatgtttctttaggagttcatgggatcttcccttgggcaatgtttgataactttaaatagcttctggaaacaccataccttgattcagcatagaaggtgggaaaattctgctgccaagtgatagaacaggatagtctcataggcagataaggttttgaaaccaggggaatgttgacatcctgatggaggtactgtttccagggtagaggcagcacttagagatctgggatctctgccctttgttaccctttgtccttccgctctctttcatttctccagtggtagctcaggttgtgtgctgtgggtgttttcttagccataggtacagaatgctgtagtgataatttttattagtgagatgccattaaccagtgttcctttgattagatatgcttcacttgtcaacctttttttttttttttgagatggaatctcgctcttgttatccaggctatagtgcagtggcacaatcttggctcactgcaccctccacctcccaggctcaagcgattctcctgcctcagcctcccaactggctgggattacaggcacctgccaccatgcccagctaatttttttttgtaattctagtagaggcagggtttcacaatgttggccaggctggtctcgaactcctgacctcaggtgatctgcccaccttggcctcccaaagtgttgggattacaggcatcagccaccacacccggccagttgtcaaccttatattttctcctaagtattccctttctcatctcttctggctaaaatagtaccatgctaagggaggattggtgctgaccacctgtactagtaatgggtttaatattgctgaggttgttcattcactcatacctacaatcattcattcactgaaaaatatttttgtgcttcttatttgtcaggcgtaacacttaatactaattgtatgttggtggataaatcaaactcctgcctatgaggacagagatatcatctagaacaagtttgtaacggtttctgtggttcatgattttaacataaaattttattaataagaccttcattccaaaatgttgcttattctttcctttcatttttttctacactacccccttacttactctttctagcttaaagtgtttctatcttatttcaggcatgatctggcaagaggacattatttctctaagtgtttacgatcactccgggtattcagtcattgttgtagaatccatatgtcagattgcagccagtgaatatgtggctttcagacctttggatttggttgtctaattacctcttgtccctttgacttggtttttggtcatggaaagttaaacatttctctgtaatgaagttaagttctgctgaaggatttgatatttgagtatgatacctccagtaaatcatttagattttccttgtttagaactggaaaaaaatgttaatgggtttggaatgaattgattcaatattaagagcagtgtttcaattcaccttattatatttgcagtaggccaaaggttgtgcaacctgctaatctgcatcagcttcacatgtgggcaggaatatatgggctgatttggcagatatataaagaaaggctaattgtctgaagaatttcctgatcaccttggaaattcaggatgaatttcctgatcaccttggtactggaatggaaattctcaccactagtttaactgtaattatttgtaagggatttaatttacaaagtacattttaatttggttttctatcattggacacttagaaagtatcatgtattgccaagctaccaccttagtaaggatttgtttttctggttaataattcagtatgcttactttttaaagtattttttccagtagagcagaagaatcgggaaaatctgggaaacttcccaggttcagggagggatgtaaccctggatgctggaggtcgagggacatccaaggccagcctgttttgcttcacagttttgcttcaaagtggatcttgctagaattaatttcaaattggaaagtcagaccaaaagcatgcagatagggaaattgtatctggaaaaacataggcattatatatatgatgtttctggttggcaggtgtgcttgaagatgaccagctaagaaaccaataccacattcttctgttttgtgttttaatattttcaagctcaagaacagaacatttaaatttcctttgattctgctttatggtttctagtagcccaagaaagctgataaggcagtaactttcatgccacttaaggacctgaagcttagatttttgttttgttttttaaacaatgtatatcaatagttttccagctcttgtggttcatggatttatgtctggattctaattctgtatttggtcattggatatagcatctgtgacataaaaacagcaatcagaagtacaggcatatggtacatgttgcttttcatatacccaaacattgtttacatttttttcttttcctccttctctcccctttctttctcttctccacacgctgccttcacttttggctttctttttaccatcctcccttttcttttagccatctcatttctgattgtcttctcctcttctactttgtcctttctcatcctgctgtctccttcttctctggtttcattaatctctcatgccaccaccagattggtttctctgcctgagtattttcagttccattgccactagagctgcttctcccctcttgcctctggagcagcttcagtttacatactgatgatgaggcttcaaaccggaaaatctcataagtctcgggtgaaaacgacatccaagcgagttcacagtgcatgctggcagggcaatccgactgctctccatgttataatatgataaccttgtggctttgtgctgacatgccatactagaataaagcctgctgccttttaaactttgatacactctgttatcatattatgattcctcatttttagaatttgaacctttacagtatcttgcattttaatagcacaggttgtttttttttttgaaaaagaaaaagtatataaattcatgctctatgaaaatgatttattctggtagctttgtttaattagtatatgtcttctgtatccaaatgcagattttagtttcttctttttaatctcccgataataagacagacatattaatcttatctgataccacttggcaaaaggattggttaatcttggaagaaaaaaaatgagatttcaggaaatttaaaacacattgtaaatgggcatgattaaagaaaaaaatgaaaaacactgtgttcagctgggcacagtggctcatgcctataatcccagcactttgggagacaaaggtgggaggatcacttgaagtcaggagttcgagaccagcctggccaacatggtgaaactctgtctctactaaaaaacaacaccaacaacaaaaactagctgggtgtggtggtgcacacctgtaatcacagctacttgagaggctgaggcatgagaattgcttgaacctgggaggcagaggttgcagtgagctgagatcatgccactgcactccagcctgggtgacagagcaagactcaatctcaagaaaaaaaaagacaaacactgcgttctaaaatacaaggttggttttttttttttttttttttttaaccaaattctaatgttgacacacattttcctccttgtagtcatactttactttttaattattcaaaattgattgttaaacattttatgtcataacataccccttgagtcatatcagctatgggattctgtattaccatgtatttgtcagcttggctagagggaaactgttgctattgatgcagtagagacctggtttgtattgtcttctaaaattagaatgtggtgtgccttcggttaagataggtttctgtcagtgcggctacagagctagctaaatttaacaatgccatataggcacatatgtgcacatcagatctatgaagacaaaggctgtgttatttcagatgcaagagaaaatactttctgatttttaagaaggtccaagttaatgctattaactcgagtaagaaatgacatagcaagtaaatgagtttttaaagaaagaggtggagtactaacttagggtttggaggaagggacaaatttaaactggactttaggcaatgtccagagttggtcctcagggtaaggaaaggttgctccaggtggaggggaagtgaaagaacatgagttgagcacagccctatataaagatcaggtgtgctagggaatgagagaagaacctgtcctttcaggaacaggtgctttgtgatggaggtggagagctgtccagtggagagagagtcataagacagaaaccaagattcacccttgctattgatctttgtaaccaaggatgatcttttcaaaataattatataatcccgctcattttttccttaaaatttttttgtcttcttttactttcctgaatatgcccatagtttacatattcccattgcaacggtttattttcaaataatatcttttctttaaaaacaacaccaaggtccacattgcctttaatacattaactaccattaatatttcttctacactcctccagagtaagagtttgtttttcttatgatgatgatgatgatgacgatgattttttgagatggggtcttgttctgttgcccaggctggagtgcagtggcacgatcatagctcactacagcctcaacctcctgggctcaagaaatcgtcccccttcagcatcccaagtagttgggcctacaggtgtgtgccaccacgcctgcctaatttttaattttttctgtagagagacggtctcactatgttgcccaggctgctctcgaactcctgggctcaaacagtcctcctgctcagcttctcaaagtgctgggattacaagcatgagccaccatgcctagccaagataattactttaatggaatggcatttcatgaatagtccttatctgaatatttaccacttgtatccttagtggatttacgtgaagagatgaagaattcaaatgtaggtccttgtttatatatttttaacactgcagtcccattcctggcgatggttttcatagaagtaattattaaaagtatttttcagtggtacaaagatacagatagcgttgatgtaatttttattggtgagaaagccttttcttaaatgtctgttgtgtggcagccactgtactaagggcctcgggggatttgctgttcacagtttactgcctctgtgagattgctactgttataccactgtgaggaaactggggcctgaagtagtagtgaaacaacttgccttgggtcgaacagtaagtgaaggaggcaggatctgaattgaagtggcttatcaaggattggaaaaaacactgaagaggcctcagcaaattcttgtagctgtggtccagtgccttcatgggcaagactgattatggacttagtttgtaaagggtgccttgccaagggttaaggatacagaaagatatattaaataatatatttgtatatgatttgtggctgacaagggacttaagtatatatatgtttgtgtgtacacatgtttgtgtacatgagcacatatatgaaatgtcatgtgagtgtaacaaactctaacaatacggaaatgtagaggtgagagtaaacagcagaacctagggagtgattcacgagacttggtgtggatgtgaaacaacaatgagtaagacccagaggggtggctgggaaaagggagaagtcaggagagtgatctgagcggaggttcagtggtaagaccgcatgcttcctttaggagacagtgaagagatgagcctggctgcaagtcgtttagagacagtttatgtactattctgaaggttagtctgtgaaattgtcactgcagctcattggcagtgattttgttggtttttgaaaagaggggataatatgggaagaacatagaaatatttccatttaaaggtcacaggagtgagatggtttccttggacacatttcacatggggctatgtcctgattaattagcccccccaatagcaaatgcctttgacaaatggaatataatgaaaaataagaaaaatcaggctaatagtgactctccattcatatgatgggttgccagcctcccctttcatttgctccattcaaaaagtatgcactgaaacctttgattagaggctctgatctagctcttatctggtcctctaatgggacgtatagacagcgtttcaatgcctgatttaaaagttcattaggaattttgtttacttttttctttctttccctctttctcttcttgatccctctacctctcctttgaattatctggattcagctgtttcagctctatttcttttggctgtagagacagtcagaaaactgcctggcccctttttttagcatcatatattttatgagtttaattgatagaaaaaatatgcccaagtgatgtcatgtctgaaggataagaaagaggaaacctaaaaccccaaatcttggttaaagttctattagcccagaccttggaaccataaaagactggtacaattctgccaaattctgtaacatacctcattggtgttgcatttcagtgggttgaacccttatgtcagcttccgagggagttctatactattctttatttataggtagatattagtttgagatctgaatagtgtgacagactgcattttccttacaaaaatgctttttgtcagcgagaaaatatagcttttcttttacttgttcccattagggcttagatattatgaatctcacaaatgttggcatggaagctccatagaaggcttgtggaaaacctttttgctagactccaggaaagcctggttagttcaattcaggaaacattctttcaaggttctgcggtattatgtagtctgggtattgaagctcaaggagaaagacagacatatacacaactcacatactagaataagtctaaatgtctagaaataagtgtatattgttgagacaatagatgggtgatcacagttacttcaggacattactgggtgagcaacggcttccattttggtgggtttttttttttttttgagacggagtctcactgtgtcacccaggctgggatgtagtggcgtgatctcggctcactgcaacctccacctcccaggttcaagcaattcttttgcctcaccctcccaagtagctaggattacaagcactcaccaccacacccagctaatttttgtatttttagtagagcagggttttaccatattggccagggtggtcttgaactcttggcctcccaaagtgctgggattacaggcgtgaaccaccgcatctggcccattttagtgttttctaagtgcttggtgctttacatgtattagcctgttgtcacactgctataaggacatacccgagactgagtaatttataaaggaaagaggtttaattgactcacatctcagcatggctctggaggcctcaggaaacttacaatcctagtggaaggggaaacaaacatgtccttcatcacatggtgacaacaagaagtgctgagcaaagggagaaatgcctcttatgaaaccatcagatctcttgagaactcagtatcatgagaacagcatggaggtaaccacccccagattcaattatctcttactgggtccctcccacgatacatggggattatgggaactacagttcaaagtgtgatttgggtacagacacagccaaaccatatcattacagatataaatctctgagtaaatccggtgtttgatttcttctagctttttagcttatgagtagaggtctttctcctctactccaagaattttcatagacacaccacttagtacttacgtttaccaccattgttattatttttaagaatgtactactttatatttttaaacatgaaggactagctcaaaattttgtagcttccccccccgccccaatcttttttttttttttgactcctttgtgatgggtagtggtttaaagacagcaaaacatgactttaaccagaacactaactagctttatacataattcagcctatgaacatgtatctggcaagagaaattcctgatctgtggttcggcagatccatgagagctgcttctccggattttctttgctggccttgcttgctttttgtgctcctgtcaaaaactcaggtttcgcttgctggttggagctcactaacaaaaatagcttctttccctatagcgcctgctgctggtgctgtgcaggttgaggtgttccatttgtgctccttgatagattcattgttgagcattaagtaggtggctgggtgcagttgtcacctgagtactaaataggaaatgttctgtgtagatttcttaaaagatatttgcttagccgggcgtggtggtgccacccgtggtcttagctccttggggggctgaggcaggaggatcacttgaacatgggaggtcaaggctgcaatgtgcggagatcatgccactgcacttcagcctaggtgacaaggtgagaccctgtctcaaaaaaaaaaaaaaaaaggaagttaaaaaaaaaaaaaagatacttgtggctgggcatggtggctcacatctgtaatctcagcatttgggaggtcaaggtgggcagatcacttgaggccaggagttcgagaccagcctggccaacatggtgaaaccccatctctactaaaaatacaaaaaaattagcttggcatggtggcacatgcctgtaatctcagctacttgggaggctgaggcaggagaattgcttgaacccacgagacagaggttgcagtgagccaagagtgcatcattgcactccagcctgggcaacagagtgagactctgtctcaaaaaaaaaagaaaagaaaagatatttgcaaaaatcgcttagttttttaaagtctatcactcatactagcattgagttataactttttcttttattaatattttatgtacatataactattggtatctgctgggatatgcataacactaataaaagggtttggagtaatttgtttggttatgatcttaagtcagttttgtaatctgtaatctgcttctttctgcattcacagagctttgtgaattctaactggcagctcttccaagatagaatctcatctttgaatgctagggtaacatttagagttttagttcagtggaaaattagcaggtagttctcttaagtttatgtagaagaggggctgggaaatttggtgctgttagtttccgtacaaaatcagccctagatatcccttccctattgtatttttctacaaatggcaggagctccaaaaattagactcagctattttctgtctctgggaagcccttcttttgtgtacaagcatccagggccccaaaggctcttcttgccagcctgggagaagaaaggctatcagcatggcatttagataatcagcctcagtggtccaggaattgggtcacaacttctccatatttcatttcctgtttttctctttggaatctgagggagtcctttccaatcctcacatctcagggaaccttccccaagtcaccagagagacctgattgttccatcaccttcttagacctgttcccatcaacttgaaagttacacttcagaatgaataggttggaaaagttacacttcagaatgaataggtctctaaatgtctgttatggaatgctggtgaaatggttgaattaagccctctgaaaatgttctcatccataaaagtgataagaaaactggcaaaaattactggaataaactttttcagaactctagaaattaaagtcttgcagtaacccagggagcatctattcaggaaaagggactgattctcagagcaggaagttttgtggcattttaacttgttctcattcccatccctccctctccagttccacagtagccttgaaaaccagtagctgcaatcacagtgaaaaccagcagcctggcagcctctggcaggggcaggatggcgttggagtgtcttcaaagcacctctgcctcctccttttcctccttctcctctcctggctctcccttctctgagatttgagaactgctggtggagaggagggcccaggggagtgcattgctgctgaaactgatttcaaatttcagtttagggaacatgcaccattagctgttgacagagtctgggatcatgcaagatgtattacatgggacaggactaaataaagctcatgtgtgccaattatccatgggagtccatggagaaactgatgctgcctctcactggagcttttaaagtataccacagtgaattggagggacactctccaatttggttctgctcaaattatgtgaagtttcataatagcttcaggaagaaaatattatagtaaccgtttcactttatgtaattctgtaacagaacacatgccaagggtgttagtttgccacagaggtactcatgcctcctactgagtcactggcttaatccctgcaaagctcaggcctttgtagaaagtttattcaaacaggtaaactaggatgatcagtgtttggaaaacgaagaaagtttagcctagagggctgtggcaaaggacctgatgcaggctgccttatcctctctttcaaagatagtatattgaattgatttatttgtgttaagatgattatacaacagcatcatgtatatacattattttatagttataactagtttcatttgagcggtttgaatgttaattggtgacggattactgctgtgatttttttttcaatcttaagtgaatcggtgtgacatttatttagtagagttttggggcactaatcaattagcctcatctttttttctgtggaaactgtttgccactgaattcagccttattgttatctaggtggacatttgcaacaccaggtagtaagattttcaaagctgagtttttctaatgatatttggttcttcagtcctgtgtattgtggagggatttggtctcatcacagaaatctgcaaatgtgcttcatcgggtagatcaggaccagctctccatctaaaaaggccttctaggagacatcctacagggtgactgaggaagagtgtgatgatccccttatctagttagctctctatcttaaggtctaaacctagaccatctcagtaatgtttagcataaacaataggtacttagtaaagccaactttggggcttaaaaaagagatttggtttgatttcctgtggctggtgagcaccagaggccatttcctctagattgcttaccttgtctaggtgttcttgttgtggtaaagtggctaatatcttgtaaatcctcattctgttgctgttttagggtcagtaaagccatctcctcagggaagtggttattagatagtgtgagcttctgcagggcgcagtggctcatgcttttaatcccagcactttgggaggccaggaattcgatacccacctgggcaacagagcaagaccctgtctctacaaaaaaaaattttttttaattaactgggcattgtctcttgagcccaggaatctgaggctgcagggagccgtgatcatggtactgcacttcagcctgggtgacaaagtgagacccttgtctccaaaaaatacatggtatcaacatcatgcgttggagctgaattcaaaacctgtttttttttttttttaaagtagtcatttactcacatggtaattaaagcaaagaaaccaaatatacagttacaaaaattgtcagattccataaaatatgcatgatgaagaattgattaatgtacatgctaacccatggcacagtccctaaaatctagtcttgtatgtttaagatcatcctaagttgagtcctttgaaagtaaattttcagaggtaaagaattatgacatttctcagggtgcatttatttagtgagaggaaatccttttaaaatgattctaaaatatagagcaaaatttcctattaagtcaaaaaacatcctcactttcctaataagtgtcatatatagaataaagatttaaaaagagaaacttgcttaccaaggtattggccactgtgttctgtaagagatgcctatatgctgctgtttttgacaaactaagccttaattcaccatgatgaaataattattcagggtgagaaatgacacctatctaggactgaagcagaaaatgctgccaggatgacaggatgtgaacatttgataaagaactagccagcacagacagctgtaggcggtagctttttcacatgatcacccagcagattgttgatgagtcaggttgatgatgagcaactcgtggaaagtgactgtcctaaatcgcagtgaggagacttctggttttgcctggtctcatctcatcccttatttgctatgtagatgtaatgtctctgggcttccgttttcttaactgtatcaagaaaggattagagtaaatgataccatagctcttcagtgctatgattttgttgttgctgttattggtcgtgatggaggtttttaaatttataatgttattattttagacatacaagttcagatactaccttttattactactctatttttatataaacaaataattggagaaaataatttttaaaccaaataccatacattttagaaaaactttagctctattgtttttgagcatagaatacaactaataaacaagtttctcatttttttattgacatttatatattgcgtattttctaaagtctttaaatgttaataagtatgtatgtgttatgtcatattaaatgtattttaagtgttgatccagaaaatgtatttgagattagctatctactgcaacaaatagaagccctttgtgttaatgtttgggaagtagaatattattctaattaattttgttgctttctacactccataaaataatgacagggacattttagcttcttagaaagagactattgcaatatagatcaagaactggatcagtaaataaaaagaaagaatgtgctacattactttacacctcttaagaaacacaaataaggctgggcacggtggctaacgcctgtaaccccagcacttcgggaggccgaggtaggtggatcacgagatcaagagatggagagcatcctggccaacatggggaaactccatctctactaaaaatacaaaaattagcggggcatggtggtacacacctgtagtccgagctactcgggaggctgaggcaggagaatcgcttgaacctgggaggtggaggttgcagtgagctgaggtcgtgccactgcacgccagcctggtgacagagcgagactctgtctcaaaaaaaaaaaaaaaaaaaagaaaagaaacagatgtgtaaggtttgtctacttgctggaataatgaaactgtattaatatttcaaagtgatgcagaaatatgacactgtagagaataacctctcccattttccttagagactggttttcattagtgtatcttctcaatcattgctgcatatgaatacaatttaacaaaaggcagttgattccattcaaattactctttctttttaaaacttagattactttgttttacactggaagctattgctatcaactaaaaatgaaaactctttctagtaaacagtcatgtacttaacaagtgattccattaaagaaattcaagactgaggttaaaataagaaagatagaggaaggggaagaacttcagatgtagattaagaagatgatatatgcttgggtctcattggctgtgtgattagtttttaaagttgtaccagtctctgagacctccaaaaagtgtgttaacaagcatacccaagatgggcttatggcaaagtgacacattataaagctgtattttagaggttgaaatcaatcttactgttgccatttggtggcggttttaacctacaatccttgttttggtactggtgaagagtagtgtctgttaagtgcatgtgcctatgctaagaaagtaacctgttgttttatagaagtttctctttttgtttgtagatataatacattgccaagcagaagaactctgaaaaattcaagattagtgagtaagaaagatgatgtgcatgtctgtatcatgtgtttacgtgccatcatgaattatcaggtatgttggagcttctggttcttttaaaaaaaacctgaattaatcagactcagaaatgactgctgggtgcagtgtacaccgcttgggcgaagggtacaataaaagcccagacttcatcatcctacaatttatctgtgttaccaaaagctgcttgtacccctaaagctgttgaaatttttttaaaaaagaagaaaaaccaaccaaacaaaaaaaaaaacagactcagattttgttctctttggtttctttgtattatttctatttgaagtaaatgccaggatttaacgagattctattaaaaaagaaaggcctggttcatcctaattctcaaggtttaattctttgctctcatattttaataaatatatataatttgtgacgtatttaaaggaaaggtgttttcctcctatagagataaacttacctagattgcttggtgaatgcttgtgactactaaagattgaataagctgctgttgcaggtagtaatgaaacaactctagaacaccaggaatggatagagacagtggttctcaaagggttatatggcaaacaggcaaaaagttacaattattgacagttgggctcagtggttcctaatctttataagaagcacctagaagatcgttgaaaatgcagattcctcctttgggtaattgagatgcaggttgaccccactgtaaaaacactggaagttacggtggaacacgtgtgctgggttaatcttaacaacaaagtggaagttagagcctgtagtacctagcgtgaactggtagggtcatcagtttaattaggtcagcaaagcaggggtacaggggttccacttagaaaagtggaattcaaatatagaaataggatttgatttccattaatatggatgctacagtgggtccaagtagaagtgggagataaatacataggtcgagggttggtgttagagttcaaaccaacacaaaaggtgctgtgttaaatttaagaagggaaacatgcatttattctttccatttttttttgaactttgccagacggcccctgttccacataggcaactgagaatacagcattgaataaatctgtggcccagggaacttactttccagggaggggagacagatgaccaacaaataaattggtaaaatgtatatgttccagataataatgatgaaatgaaagctaatgcttacatgttacacttttcaggtctagtgcttttaaacctcttaagtcatgtaaatagccctgtgagatcaataatattactctccccattttactgatgaagctgggacacagagaagtttggtaatttgcctaaaatcacatagctagttagtagtggagtcaagatttggacccaggaacactttgaacccagagaaccattactaagtactgtagaaaaaataggaaataggaactgctgaaaatgtgtgcgagttttaaataggccagctagggaagggtcactgagagggtaacatctagtaacaacttgaatgagggagcaaagggagggatattaggggaagaaggttctaggcagagaaaagggcaagtgcagagaccctgaggcaggaatgtctggtttgcccaaggcacagaaaggaggcttggctggatcagaatgagtaagagggagaagagtagaagatgaagtcagatgtgacagggagtttgattatgtagagctttagaggccgctgagaggacattgacttcactatgagtggaaagctattgaatggttataacgacataatctgacacttgcatttaacatgagaccatgctggcttctgtgtttaggtttgatcttggccaggcaaaggcaagagggggtagaccatttaggaggcttttagcagtaatttaggtgagctttggtggtcatatggactaggatcataggagtggagatgatgagaggtggtcagattctggttttattttgatgttaaaggccacagcattggatatgagggagaaggtgagtagtagagggtggcaccagggcttttgtcttgggcacctgtgagatatatttgctatctacaaagatgggaagactgcaggatagatggatttgagggagatcattaggaattctgtttcggggattttaactttgagattccccttagacattcaaatggtgatcttaggtgcatggttggatatgccagtctggatttcaaggcagtggtctaggctggagttagacatttgagagtaattagcatataaatggcataggaagccaggaaggtgaatgagatcagtaggggtagactgagaagtaaagaagtccaaaatatgaactctagggctctctgtttaaatgtcagagagacgaagaaaagctggctagagagcctgaaaaatagccaagtaggagccaagtgaaggacatatttcaaggagaagggagtattcagctctgttagatgctgctaagtcaagtaagatgtggagtgaggattggccattggcttcagcaaagtgcaggtctttggtgatcttggcaagaacagttcattgggatggtgggggtgaaatgcttgattggagtggtttcaagaatgagcaggaagtgaggatttatactgagtgtctggaggagttttgctgtaaaggatagcagagaaatgagaggcagtggctgaacacaggttgtggtatcaagagaggtttttattgttacttaagataatttgcattttttatgctaatggcaatgagtctatggagagggaaaaataagggggaagggaggaatttctggaacatatgatgttcgtgagcagatgcgagggaatgggatggaggaaggactcatgggaggggttggccttagtttggagcacagaagagttcctctttaataggaggtgaggaggtaagccacaaatctgtgtggatagattgatgtggtataggaacttctggatgttttctctgatgagctgagagtgagttttgaggagaaagaatatagttgacccttgaattttgtggggtgtgaggggtactgatccctggtgtagtcaaaaatctgtatataactggagacctcaccagtagcataaagtctgttaacacacattttgtatgttatatctattgtatactgtggagtcaccctggaagcttaaaaactcaggtgccaggtccctgtaattgagattcggagtaaatgttttgtttagtcttccaggggagtttaaggagcggccaaggttaataatcactgggctagagcctttttatcattttaataaagagaaacatgtagttcatttgtaaagaatgggaagataatcttttgataatagcatcattgccgatttttttttttttttttttgagagatgtgggtcttgttgtcctggactcaagctgtaccccccgcctcagcctcctgagtagctgggactggaggcacaaatcattgcatctggcattcttgaaatttttaatagagaaatatgctctgacagtgatatactagagacataagtgcatttataatggtgtaagtttcattaggtagatacttcgggtttttggttttaaatcaatactgacagttccctaacttgtctcccaatgctttgtgtttctttttttttccatgttaattttagtatggtttcaacatggtcatgtctcatccacacgctgtcaatgagattgcactaagcctgaacaacaagaatcccaggtaagctgcttttgtagtacgcaagtctaaatctatctagagaaaacagagggctagtcaacacttaaccaagtttgactttggaaactttcaagtgttaatctctgaaataagattggctataaactctttggctgtgtaagaatttttccttttagccaagttacattcttagatgggccagagttgagcaactggtgacaattctagcccttcactgttctcctcaagcttttgttcttttgaggcctggtttccagcatccttgctgctaaatttggagaggatcaggttgccaggactcgggggccaggagagtcttgataaagatttacgtatatcagttattgctggaagctagctaaaaccaccatccttcgtctacacttcgcttgataactttacatatgtagctttaattactgaacgaaaatagaaaaataattgtagtggccagccgcagtggctcatgcctgtaatctcagcactttgggaggccgaggcaggcagatcacctgaggtcaggagttgcgaccagcctggctaacatggtgaaaccccatctctactaaaaatacaaaaaattagccagacatggtggcacatgcctgtaatcccagctactcaggaggctgaggcaggagaatggcttgaacccaggaagtggaggttgcagtgagccgagatcgcaccgctgcactccggcctgggtgacagggcaagactctgtctcaaaaaataaagaaagaaagaaatagaaaaataaaattgtatatgcagatttcctttcatattcaccaccttgtaaaggctagcagcagatataattcacatcacacgttagtcgtaaaagccagtcttcatcaattgtagttattttaatgtgctttccattttggtgaagtattctgtacttcaaatgtgcaattccttttcatccaatacctctctgtagacaaaatatctgaaaactgttaattcaaaaatctgtttataaattagccatttctgatttggaaaatgcaacacgaactatcaagtcctctttactgaatattattctttcaaacttcccctgattaaaccttttgcgactgtgcgattccttccttcgtttactagagtcctaagtagccatgcttctgtgtctctgccttctactacagggaagacattattttttaaaagacaattgacattgtggagtatcagaacagtttttgtttagaagttggtgaaagctgttattccagaaaaaaaatgaaatacttaagtggtcttatgattgaagaaacaatgctgtttctttcttgacattgaatttgaaaacttagagtgtatctccatgttctccttccaaaaatatttcagattgagttttattttcttgagtcaaagaaaatattcttgtgttagtaaagctagtaaagctgtaatccagctccttccagttgtcctgcgtaggaagaagaaaggacagaaacttgtattttcgtgggagatttatggatctgtccctacatgagcagatttgaaatgtagaacatgagtttcagttgattttgaacttttttttttgcaaatgttctctcactgtctctaaaaccagagcaaatacttaatcaatagtttgtttttcagcatattcccattccctttgtttttagcgtaccagtaaacatttttcatctgtattgtactgagtcacctgatgataggtctaagagattattcttctcagaactagttttcattagtgagtgatttgtctttttggtaagtataccttccaaatttgccatcttagacaaatcacatatgtagtagtcagtaaaggtttaaaaatgtactttgattaaactgtaccttagtaaaattttttaaaaatgtaagggcaaatgttttattctcatgtatcttggaaggaagaaacagctgactcatcatgccattttcactgatttgtgtttttcttcttcttgttttggcagaacaaaagcccttgtcttagaactgttggcagccgtttgtcttgtcagaggcgggcatgaaatcattttatcagcatttgataactttaaagaggtaggctacactatagttttcataagaatactcacacatcttacatttggacatctttgaacggaattatttaccttttcatttatcctagggcctaaggaatataatagttaatttctaagatctcactgagaggaatgtaatgaacttagtctaaatttggtatcttatttctaggataagttaaaaataatcacagtactctttttttgttgttgttgtttttgttttaatttttatgtttttagggaacatggaataatccagtttgaaaaccggttttgttacatgtatgtggttttcattggggttgatattggcacttgatcgtccaccatgcaaattttatgaactctttcatcacagttactttatttttgctggatgctatgaaaaacctggcaaatactggcactgattctgggagcgtgtaagcttaagtgggcttgtcacagccaaacaataatgcaacagttgagcatggttggaaacggagactgtctgaccacaaagaaaggagggattacacaaagacaatatgacgccgcgggccctgccccagcgtatccaaacatcaccgccgcgggccctgccccagtgtatccaaacatcaccgcctagatagtagctgctttcccacagggtagtgggcagtgttgtaggaccaagaagagtacctgtttgttcccctggtatatgcctgacatcagaggctactttgaggtgagaaattacaaagtagtccttagagaacaggtggaagcccaggttacaataggacccttcgccaagttgtgtgttatgctagaagtcccatttaattccaaatgcttttggattaagacccgagctggattaaaatccaggtcacagagggactgttttctctcctctttcctgaaaggttctgaactagaaactctgatagtatttattgagaacctactatatgccggggctataccagctacatgcatggcatcatttggttctataagaacatctttgagacaaatattaatatcttgattttagcgaaattgaaatacatagtttacctgtggtcacatagctagataagtgacagagccaggaacaggacttggtgctcctgatcctgaacttccttgaaatgtgttgaagttgtggccttattgtttgtgaatcccttgaaggaaataagggaaatactgaaatgagacaggacttcggagctatttcccctgcctcctacctccttaattggatttactgcccagctgccaaatgttctagacaccagcctgtgagcctctgcataggctgggaagcttcaaagatgtgaacagggcagacactcctcttgctcctttatttgcattgcctccttactgctagtccattctttaagattttgatattatccattttgtaaatgccaactgtggagacaaccaaatattatctttttttttctttctattgagccccaaagatagtgaaaaaatatccagcttccaagagaatgaagaagaataatagtgaatctttaaattcatattctggcttccaagacaaatagattttagagacaagaatgtacgaatgcttgtctgtgaatgtttttatatatcatgtataaatatataaattttacatttataaataaggaagtatgtttgggtggatgggtttaatatgaaagagaaacagtatgtgcagctcatataacgcccaaatctttatcattaggtcatatttgaaaatattgcatgctgagtacttttcacattggaaacatttactatatagttatcagtggcccttgttataatgactcatattataacaggaatctgattatactgcaggtcagattatatcctaaagatatatttgtatagaacaagaataaaagccaggaattcatgagatgaatgataatatttttttctcctaggtaagatagagtacctttcttatgcatagtaggcccacagatacttgcagaattgagttttaactctttggtgtcagacttatatatgctttagctatttagggtgtagtatgtgcttaattgaagaaaaatgtaatcctaagtctaatacctggacaatagtaatgagaactaaattacttttgacattgaattcttagagctttaaccaaaactggcctcatttctgtaattaatcaggagtgatggtaggtcttcaggtactgtccttggcataggcatttgcatctgatagaaggtgatagcagtgggctaggggaggtcctcaaatgctggtgggaccccaaaccctgctggtgtctaggcgcttgacatcctcacaagaatgaattcaagtatgagttagaaaatagtgaaagtgtggagatttattgcaaagcaaaaagtacacactcaagaaaggggagtgtgggcatgcttgagagagtcacacaaggtggtttggggctgctacctttatggatttctttaaccaagggatggagtattcacggagattcctggaagaagctggagatttctcagaactatggtgctacccatttttacctcaaataacgatgttctggaactgtcatggcactggtgggtatatgattgaatatgtgaatgagcatagaataaggtcctaggagaaacctggatcaaatccagcaccatgttggacccagtttgtctttgccagcttggcccacaccctgtttttcagggtcttatcagccccaagcttctgcagctatttcagcagtttccttttgcttagtcatgtgaaactgctgcctagaattttttattctgctgcaaccatcctgcattattcttgtctaaaaaccatatagacagaccaagcaaatggattattatcctaatagccatgggaatgaagacaaggtagcaacatgcccccgacaaacttagttgttatagataggtcagaagagcctcaaccgatttatccaatcttgaggtgcaaaaggtgttattctgtgttgatcttgctttctaaaacatgcaatgccgctcacagctcaaagtctcttaaatcccttcctctttttctcccatctttgcgtgagtgaattttttttttttcacatcatagtaaagtgaattctttaacctctttaaccaaaatgtcattggaatcttctggttttataataatattcattattatattctggcatgcctgtgcagatagggttttgttcagtgaataattccttttgagccacatatggcagagagagtaccataccaggtaccaggataccaggaaggaggaccaaagaagagtctttgccttcgagaagattgtttttaaagcttttcatcttttttagtaagttgggattccattcatctgcctaagaaggatgaaaggattatctttgtttttattggcaggaatgaggggtgaagtaggggagttcaacatctattttttgcaaataaagtaatatgctttagagtagccagatcctttgggctttgatcactgttagagcatagccaagcgtactaacgcaatatggaaccagatgctagaaagacatttaaaaggccatgtatcttaagtagtttatgtagcaggatttttccccctctacctcttgagccaataaatccattctatctaatttgaccaccactaattaattagttcagatgtaaattaaaggaagttattatttggctgttgaaagatttttatgtatgactacatcattttctcatgttttgatgaatatttagaatcccaatcttatattttttttccttaaaaaatcttgctacaaatcttgtaatagctgaagtgcatgttttaggaaggcagggagcacctttagtttaatggtatgtgatggtggcaagaatgttaacccaaagctttgcttatggtgggggtgggattggggtctaagcctgatgtcactgagcaaacacatacatggcttcaatgtacatgatgacaaatgagtcttaattacatgaatacagatagtaagcttatactgtgcgtggtttgtgacatgcctgaaaacatgagtgtattgagtagatgaagactaaatcattaacagtcaaccattgtgctccttgaattcttttttccttaaaaaacaattttttaaggggattaacacatctggttttgtgttgaaatatctcttaacgaaaatttatggtcttgaaataaagaccagggtgagaaaaaggagtcatctattttttcttattggctaatttattaatagccccatggaaggacatatgaccatcttacctaaattgatgttttcttagttgtgtggcagtgtatatttttgagccccgagactaccaaacagaaaaaaatacatttggaagtaaaaaccaccctttggatatttatattagttcagagtcttctttgcaagaagcagaaactgactctaacacatagaggaaagggttgatcgaaaagatgttgagaaaagcacagacttgacaaggagcctggagaaccaggcttggaaaatgggcaggcattcctaaaatgtggctatactctggctctgcctttgaagctgcgccaccagaaataccatttggggttctggtcatgctttttcttctcttccaaatgacatggaccatagctagcaatctgctggctcataaaactcttatctactggttaaggacctcaaccagtccccacttcagatttctaaacactacgcttcatctcattaccaaggggaaccttgaagtcttcaacctagctcttgctctcaactttttcttagtctttttactttttccattatattctttgatatatttgagaaaatggcttgcttttaaaaagtgtctccaaaggtttggcaaaaaaaaaaaaaaaaaatgcttccttctgaagtcaaagaggaaaagtactgaggccctgtagactctacagtggaacagccactatgacatgagtaataaaatcctctgagggctttgaggcaccagctctcccaggctgctgggaggtgcacctggaattcatcaggatttcggatcaattataactgtattctcatctgcttctgtaatgacagcatctggctttagcaaaaaagcctgagtttggttattaaaggctcaactccctcccacttttgaccttccagtacagaaagatggagccttgttgaatgagtcactcgaggccaccagcactcttgtgcacagcactcttggcagtagttgttcttttttctgcctgttgctagaaggcttcctaagaaagctgatgtgtggtttagctactgggcatctgaaggcactcgtgctacacattattaagttgaactaagaaagcctgtcaagttttatttatagtggaccaaattgggcaggaaggagagtgaagattttggtgtgcttccagcatccctctgagtttaatcccatgtaatctaacctcccaagcatttgagggtataggattgtaaatctagcatgagaccatccagataacttcctaagtggtaaagtaagggtactcacatttttcagtctctcattgaactataagcaatgtattctctcaagtctcaaactgtaggagccacagccgtagagcatgtatgtatttcatggtatcaggccagaattagattgatctaattaaccaagattcttcttgactggtcctcctccttagcattaggaagcaaagtcctagtcttaatgtggtgttagtgctgctgagtaactttttttgtctgtttatcaactgttgcaattttttgctgtggatacgaaagtaccccacacttcatttttttaggctcctggcttctgtgggtcaggaagccaggctggcatggcagggattgtctcttctttgttttgtctggggcctcatcagggaagacctgattgactggggatgccagtccatctggaggctgtttcacccacatacctagtttttgagctatgatacctctcaaggactgggcccagctgggactatcaaccagagagcctccatgtagaactccacgtggcttgggcttctcacagcatagcatctggcttctgagggagagtgccccaggaaggagcatctgaagagccaccattcaaagagccagaggctgctgagtgtcttctgagctggtcttagaagccgtgtagtggtcacttctgccatgttatctgggttcccagtgaggccctgagcccaacccggatgcaaggggaaggcaatggcttctcttcttgatgattggccgtcgggttactgtgcagaacatgtggggtgggagagagagctgtgggctcataccattgtagtctgtatacctcagtaagtctcgtacctcagtaactgtatgagatttaccaaaatgtttattgttattcgtctttcattttctccctcttctttactcaatccaatacttggtttttccttttgactgaaaactttataaactttttgattggagataaaaaagatagtttttaattctttcatgtgaatctactatgggcaaatgatattgtgagagccttccctagagaaaggagccattttcataggatgtccaagtttattttctggtaatgaactagttatttctttaccattagtgtctttaacatctggttaagggaatgaaggctggtatcctcctgattgttaagggatgagtcatactcacttactgaaaaaaatgtgagtgctttctatgtgtcagaaacattgataaatattggaatatgaaaatgaatcagacatatgccctgcctttaaaagagagcctcccaggctagttgaggaagcagataaatacttcgacagttgtaataccaggctttataaaggtaattgcaagatgctctgcaaagaagaggaacagctgaccaagacaaagtagggctggaggcagatggggaaagagctctcaaggaggctccttataggagagggtgcctgaacagagtttagggtgaacaaggttaaccaggtgtattcctttcccattgctgctgtaacaaatgactacaaacttagtggcttaaaccaacaccagtttattattctacagttctgtagaccagaagaataaaatgagtgtatagggtggtaatctctgaaggctccaggagagatttcatttccttggccttgtcagcttccagaggccacttagattctttggcttccagccccttcctccagctttaaagccaacaacatagcatcttgtctctgtctctctgcttctcttgacacattgccttttctctctgacttctctgtccttcttcctttaaggacccttgtgatgacattgggcccatccataataatctaagacagtctcccctcctgaagtcccttaatttgatcatacctttgcagatatcatcatacctttgcagatatgatcaaattaaggaacttcagatggggagattatctttttattgtataaggcagcatagtcaacaggatcaggaattagcatgtggacatcctggcgggtaggaggaacacatcattcagcctgtcacaccagataaaaaggagtgaggatgtcattttataccaagaaggtagtattttaataaagcttcaaggactttagtttgccccgaatctccagttttaaagagcttagggcatgggaagagaaaaattgggataggaaattaaagggagatcagaaaaggcccccttgcttatcccaggctcttcatagtgccacacagcctaaagggagcaaatatgctccccagtcacattggctgtttagattgactctattaataaagaatttgctcatatgttttgttctgaaagtcaattaacagtgggctcagcatgcagttgctttgatagagcagggtgtgtttggggtctgagatttgtttcagaaatcttaccattcatatttctcattccttgggctcctttctccaccgagagtcatctgcttcatcagctgccgtattcatttacttatcacgtcttcaggactgcccttttttggtggtcctgggggagcttaaaaaaaaaaaaaagaggaagtacagcagggtaacagtgcccagagccagaccagattgtcacattatctgttgtacaaatgtagagatgctttgcttcacaacttgactttaattagaccccttctgctccacgcaagcctgagtacaattttatgcaatagggaacctcatcctctattttaaatgtagcagccacttaaaaaaacaaacaaaaaaaacaacaaaaaaaaacccagggtgttagggtgttgctgccgtgttatttctattcctataaaaatgccgcttctaaaatgcatgccctttgccaactataaaagttggcatatgtgcccttatttcatattcttggaagataacgaggagaaccccaagagaaagcagtgagagctgagtgttattttaaaccctgcagaacttgagacagagactggtactgttccctaaacatgagctttcacttgggaagtatttctttgacgttttgatattgtctggtttaaggtacagaaggacactatgaagcactctgctgtgagctgatcagaaaatcggagtcaaaactatgacagctttggcaatatcaccaactctaaaaagcatttgaatggaagttttcagtctccgggcaggatttgattgccattctggcatttatttcgtgaaaggcctatttaaggatcttcttggtttgctcttcctgtgtaaaggagctgcttccctgctcttctactccctcactcctggacctcctgggctcaagtggtcctcccacctcagcctcctgagtagctgggactacaggcatgtaccaccacacctggctttatacatatatatatatatatatatatatatatatatatatatatatatgtatatgtatatgtatatatatatacatatacatatatatatacatatacatacatatacatatatatatatataatttcttgtggagacaagatcttgctatgttgcccaggctcattttgaactcctggccttaagcagtcctcctaccttgacctctcagagttctaggattacaagtgtgggccaccatgtctggccttctagctgctttttaaagtagttttatattgagtaaaaataaaaattattgtttttatgtgtcatggaattcttgattatagcttattttagcagttatttagtccagtactaagccctacacacagggttatattaaccgtcttattaaataagcatgtgtggctcacgcctgtaatcccagcactttgggaggccaaggcaggcggatcacctgaggtcagtagttcgagaccagcctggccaagatggtgaaaccctgtctctactaaaaatacaaaaaattagctgggtggcatgtgcctgtagtcccagctactcgggaggctgaggcaggagaatcgcttgaacctgggaggcagaggttgcagtgagtcgagatcgcaccactgcattccagcctaggtgacagagtaagactctgtctttaaaaaaaaaaaacctgtaggttcaactatagctgttcaaatagttatgaagtgctggatatgttaaccaggaagaaggataagataaatcatatataaataatatatatgtgtatcagtgtgtatgcatgtttgtctgtatatttgtacattaaatatatgtgtgtgtataataggagtaagtgtaaagatatatgtgtgcacagtaataagccctaaaaggaagcaaatgagaggatttggagtggcactgggacaactcctttgtgtgtgtttatttctgttgcttggactgtttggtaagtaataatccctcacgtggctagactatccctcttgtgcagagttagattttccctctgataacttttttttttttttttttttttttttttttttttttttttttttgagacagcatctcactctgtcaccacccaggctggggtgcagtggcgcgatctcagctcactgcaacctccgtctcccgggttcaagcgattctcctgcctcagctcccgagtagctgggactacaggcgagtgccaccacgcctggctaatttttttgtatttttagtagagatggggtttcaccatattggccagactggtctcgaactcctgacttcgtgatccgcccaccttggcttcccaaagtgctaggattacaggcgtgagccactgcgcccggcctccctctggtaatattttatatggctagatttgtcttttctaaagatgctcagttatcttttgtgtaacatctctccagactaccaccttttcttcaaaactgtgaaacagaatcagaactgtttggaattgccagcagactgttgagcaaatatactttttacagtgaccccgttacagggttaggggagtttgttagaaaataaaaggtttcaggccaggcgcaacggctcatgccggtaatcccagcgccctgggacaccaaggtggaaggactgctatagcctgggagttcacaattagcatgagcaacatggtaagaccctgcctctacagaaaatacaaaaattagccaggcatgttggtgcacgcttgtggtccccggtactcaggaggctgaagccagaggattgcttgggtctagggggtcaagactgcggtgagccgtgatcacaccgctgcactccagcctgggcgacacagcgagaacctgtctctaaagaaaagataaggcagccaggtgcggtggctaacgcctgtaatcccaaaactttgggaggctgaggcaggtgatcacaaggtctggagttagagaccatcttggccaacgtggtgaaaccccttctctactaaaaatacaaaaaataagccgggtgtggtggcacgtgcctgtagtcccagctactcaggaggctgaggcaggagaatcgcttgaacccgggaggcagaggttgcagtgagcctagatcgcgccactgcactccagcctggtggcagagcgagacttcgtctcaaaaaaaaagaaaagataactcatgatttccgtgccacagaagtttgtattgccttgagaaaggtaggactgactttaataggtatttagttgaggaccaaatatacactaaggtcaacactaggaggacagtaatttaaaactttaagaattgtgcatgtatttatatttttatacctaattgtaatttaaaccaaaatgttaggtgttattgacaatgaatgtgtgtattgagcttgactctctatgtgagtcaagttcaaatttcatttgaaatttaaactcttgtaaaacataagcacattttttattgatgtgggggtctctcgtcaataagggctttgtttgttggtttcttttaaaccagcaattctcttcagaaagaaagcatgagcagagttcagaatcaattccattttcttctttattgtcaacattagtgtatttatgtcatgtacataaaaaggcatatacatatgcagaaatagtaaggctactattagttaattttctatttaataaaaaatttgtttgtttattgtttccttagtgctggcagactagtatatattattttgttaattcttagatgcaccatctgaggtaggaacatagagggagagctcagagcaaatgggcctactgacgtctctagtaaatggcaactctgggatttttacacagatccatttaactcagagttcatatacagccttacataacatgtctcacattccaggcactttccacacatgttcgtatattgtcctcaattttccaccgaaaagcaaacctaatgggaatggttagagattggatagattattggggtgtttaaaattactggtaaaattcagaacagaccatactgtttgtacagggcccagtgggagaagtgggtaggtcctgagcagggtgatcaggaagggaagagacctgatttgatggagagaattctgggagcagagagattggcatgaaatctgtctcaaaggcagcataagtcagaatatatttgttctttaaccaggaaaaatatctgaccagggtccatgttacagaacaaaacatggcaagaggcaggcatgaatgaggttctgaggaaacagtggtggagagactggaaacctgtgattaaaacaaacaaacaaacaaacaaacacctcaactagaagatagatacaaatagaagggaaaaaagagaaagggaagaaattcacagttacataatactttacagtttagaaaatgctatatatatatattgcatttgattctgtggaaatctgcaaaaagccttttatgtaatttggataaaactttaggagtattgtgtagctctgcagaaaatacagtagaggggagagatgctggagtctggaagacaggtggttcagttgtcaaatgactcagccttggacccagtttgtggccatggcaatgaatatgaagccaaaaaatgaaagaaaaggcaataagagatagggtgatccaccgaatatgagaatggacacgaggagaataagaatctgttcaaataatatacacttaatgaagaggaaagtagcccaactatagtcaacaaatacaatctggggatttcttttttcaggcaaagaaaataaaactttttttttaatttatttttttagtgggggtgtaatgcccgaggtcagattcttagctgtgcaatgaaggtaatgaatgagagaacaagtttaaacagaggtgactagggagagagagagagagagagagagtgtgtgtgtgtgtgtgtgtgtgtgtgtgtgtgtgtgtgtgtgagagagagagagagagagagagagcgagagagagccaaatggggattgtaactaagtaactaaggaggaaaactcccccacagggaccccagtccagaaggaaaagagtgaagagacaaggttagaatgggctagaaggatgctcagaagagaccagcacagtacaaaggggaaggtggtcaagaggatgagaggattcctggtgggtctggtatattgtgatgtaagtttttgctttaggtgagaagttagtcaagtggtttttatatatcttccaagtctacaattttatgattctatataaaactttgtgtacacatgcctatgtatgtaacatgtattgtgtgtacctattcaaatagttccctctaagaaagattaagtgcttctttgactgcagatatgaaaacaaggtacctagataataaaatgataggtgctttcatttttcaaacaagaacaaaaactgacatgtttgaggccagttggcaggagagcaacaatcctaaaagagatcactatgactgcagacagtattgtgacttccggcctaagttcccttttatgactacttggaaggtggctgcgtcaatcccttggctcaagtttcatttcaaaaatctgccatgtgtctaaggacgtcgctgtttccctagactgagagtgagctggctgtgctggccatgctgttagtaccaccgcacgaggtactgttgaggacttgtctgtggaagaagcatccctggcttgtgtagcttttgaaagatggagcttttgagtcttgatttaagcttttagtttcccagctcccctgtcctaccccaaactgttctgcccactgcagctcaacagccattctttattcctttcaacacagtggtatatgtggctactgcccagctctttaattctatgtatcagtctgccaagaatatatagtcagactcggttttcattcacaattgactgaaacacactcactagaagaaaatagcccagtggttcctacttatggtccaacagtcactgtcagtcacccttcatcttgcagttgagctctctgacaagatgttccccgcaaactctgcgtcacaggggagtggaaatggccagtcatggtaacatgagctttaggctctgtgttgttttggcagtttggttttggcagtggaaaataagggctccttccctgccaataactgtactagcaacacatgtgatatcccagatttactggttcaccaccaagaacaacactgaatttttcatttcattttcaactattttccaggaatagatgtaaaattagtaaatggtgctttctatgtggaacgtgtcaagaacatgtttagcacattggtaaaagataatgatctttttgttccttgtgtatttgttcatgattgattgattgatttgattgttgttgcttttgaggcagagtcttgctcttgtcacctaggctggagtgcagtggcgcaatctcggctcactgcaacctccacctcccgagttcaggcagttctcatgcctcaggctcctgagtagttgggactacagacacgccaccacgcccagctaatttttgtatttttagtagagacggggttttgccatgttggccaggctggtctcgaactcctgacctcaagtgatctgcctgccttggcctcccaaagtgctaagattacaggcatgagccaccatgcccggcccatgattgtttgatattatggtgtcaggcgtcccagacaaatttgtttacttgggtggattcattcagtatgaatttctgaactttgaggaatgtgtgttctatatattttttttcccatgcggaggagatctctttctgtccctttcccatattcttgcttgaaatctaacattcacctggctttgggaaaagaacatcttctagccttataatgagtctaatgtgacagagtgggtacatcccagagataatcagagaacagttaggggctgtttccatccaacctgataagtaccagggattgtacctggccttattaaacagaagaattgcaaggaagtctttttttttttttttttttagaccaagtctcactctgctgcccaatctggagtgcagtggcaccatctcggctcactgcaacctcctcctctcaggtttaagcgattctcccgcctctgcctccagaacggctgggattataggcatgtgccacaacgcctgggtgatttttttttttttagtagagatggggttttgccatattggccaggctggtcttgaactcctgacctcaagtgatccgcccacctcggcctcccgcagtgctgaaattacaggcatgagccactgagcccggctgtcttttttttctaccttggaaaatggtggagggctcctttctatatgaagacactattggtctctgtgtgatgtggcttcatttttatgcagagatggtacatttagtagttctttgtatggtatggttgattcccaaacaatcttgcaaggaattttactattagttatccatttatttgcttctttagattttaggtttaagaatccatcatctttgtagaaatagaggctattctgtaatccagtagtttccaacttttggcccctggagccctttttatgctcttaaaaatcactgaggtccctaaagagcttttgtttatgcaagttatatgttgatattttccatattagaaattacaacaaaatttcaggccaggcatggtggctcacgtttgtaatctcagcacttagggagattgactcgtagaagatagctgcattcttagatctgcttctgcgtttagtcacttctgctgttgtttttgttgaagtagatgaagaaaatttagcctcacacagatatgtagatgaaatagaattatgtcaacagcattttcagataatagtgggcattcttctttgatactatacaaacactagacaagtagtaatttcttaaaggttagtcacaaagtagaatccgaaatcgtatcgatgaactttttccatactgttgcattaaaatctatttgcctatattgcaccttgaatgaatttataaatttgtaacaacattcagtgatcattgggaaaataatggtacactgagttatctagatcttctaataattggcacatttcctaatatactattttaacaaatcacatgcattatttttacctccaatctcattagaaaattctttaaatactgggaagcagtcagactcctcgtggtgggtacagttttcatgtgtttgcttaatttttatcattgataacaaatattgtcagctgttatctttaaattaaaaggtgcactttgttcattttcaagaaaatacctgccaagtgcataagtctgaatttgtcagtcatgctttcaagtaagaacaaagagtggctagttcatcttgcaactgaaataatcacagaaatgctttttcctcaagacaaccatacttcaatatgcggcagaaatgctttatgcagactccccatttcatcatctagagtatcataaagatgtgtatctaggggttgagatgtataaaattaataccttttactgcttcatcaatgatattcttaagtgaaactggctttttaaaactgagaatgcgtggctgtggtgaatacagggattactggtataatttggtgcactgccttgatgcatgctatggcactggcagtattcactcattgttccttttgtgccaccagtgccaactgccaactctgtgaaagtattaagtaacatcttagtagtattatacaaataatgctgccctcacaaacctcataaaagggcctaaagtacccttggtgttcaaggaccacactttaagaactggtacccaaatccattctctgctgtcatcttgggctgggtggaagtggttccaattggctaagcgcaaaatccttctgcttaagacccagaggtgactgtgggtgttagggtgaacttggggaaaagcaaagatgaaagtagaagggttgggaaatgagagaagcgagctgtagacaaactgcaggcatttgcctgttgttggcctgagatatttggtctatccaagagtccctgtcttcaaggtctctgcattcatggcacaccatgcactgattagatttgtagtgatttaggtgtgaggagagcatgggctgatagctgcctcttgcgcaggccccaagatctgaaattgctgcaggctttagacagctctagccacgtgctcttgctgtggtttagagaacatgcgataacccctagagatgtcattgtgtcccttcccttgctcagcttgacctaattggatatgctcaaaggatgaagctgtgaagagaaatgattgaaaataaagaacagtgttaggctccttcaactttgaggggtctgactggtaagtcatcccagagaggactgaaggcctttgtcatgtaatcctcaggtggctatttaaataccattctcaggctgggtgcggtggctcatgcctgtaatcccagcactttgggaggctgcggtgggtggatcacttgaggccaggagttcaagaccagcctggccaacatggcgaaaccccgtttctactaaaaatacaaaaattacccaggcctggtggcatgtgcctttaatcccagctactcaggaggctgaggcaggagaattgcttgaaacccgggaggtagagattgcaatgagccaagattgcgccactgcactccagcctgggtgacagagcgagactctgtctcaatcagtcagtcagtaaatatcattctttattgaagaaatggaaggtattttggctttctagtagaaatgggggtgtattagggctctccagagaaacagagacaacaggacatctatagatatatctgaagatataagaggaaacattatgggaattgctcacgtggttatggaggtagagaagttccatgctacgcatctgtaagctggaaatccagaaaagctagggtgtcattcagctcaagtctgaaggcctgagaagtaagagcaagtggtgtaagttatggagtctgaaggcctgagaaccaagagctccattgtccaagggcaggggaagaagatggatgtcccagctcaagatgagagagaattcacccttcctccaaattctttttgttctgtttgggccctcagtggattggagacgcccagccacattggagagggacgtcttctttactcactgtcacagacacacccagaaatatttcaccagctcttggacatcacttcaccgtctcaagttgacgcataaagttaaccattacaagtagccttgaaagactctatgtgtccttcctaatgaccaggagatgtgagtcttgcattgaagctagagaggttcaggctggacttgaagcatatttcggaaagagatcatttatgacctattgtaaggaggagttttactctctagaatttattgaaggtcatcttttttttttttttttttttttttttttttttagagaggtagtaaaaagacatttctcattgaaggggtgatgcgtcaatgagtcgtcctttggggattttacgatccttttgcttctgtctttgggttctttattcagtacagcaaaatatgggtgtggaaagtaagacagtcatctggctgctctgtgtgcctcctgccaaacatctggatatctggaaacacctggaaaagttactgaagttttcacaagggtgtttagcattatgcgaatgaaacctcaggctcatagtcatctcctggtccaggattgatacaaatgttgtatttatgaaggaggagagttgactaggttatagaatacatttagttgcttagctttcattagtttttgttttagcggagtgagataaggttgttcagtttcagagcatttcagctggatgaacatattcacagttaaatcccaaggagacatgagagccagcagcaggttggagtgatctgcttctgtcatggctgctgcatggtgtatgtgtatgaaatgtccaatcacttcaagagacaacaataacagaccattgacagccacagaacaccccagaaaagtggttttgtcaggccattatggccctcatatagccctcagactgctggtgcactcagtagatggtaaaagatggttttcacctaggactaactatgaaataactgtttacttcacaaggccctgaaaagaaaacagaacttttgttctcaggcaggccccgagaagggtcgtctaatcagtcataatagagtgtgcctctaaaacggtgccttcctgcagggagccttgcagatcacaggggcctattgtaagaggagaaaaagaaagtattgaggcaggcgccaggcaacaaggcaagaaggaaacacttaagcaaagggcctttaatttttatataactaacccagaagcatattttatagccatctcataagagtcaggcctcaatttggctacagactttgcatggttccctgggagctgttgctggggaaagccagagactgttactcaccttgaagagggacagagaggtggctgaagtctgggagtgtgttcacttcaacatctggctggcaagataatacccaaggtttttgtaaaaccatctcctctccactattagcctttagggaaagcatcccctaaccgccgcccaccctttgagatgctttaaactatagccacctttgcctccagggtcccagattgatccaaatggtttgggacactgttcacaaatgtctttcacagatgttggagagcatagttggagctttttttttttggcagaagttttgcttttgcttcaattctcctttacatgaaaatgaatcttgcttgtcctgggagtggcccacgttatctgtgcagggtatgggatttcatagcttcacaatcaggagtgaaccagatggggcaagagagtggtttgacctttatgtttggtattcagggccagcacagccaagtgcattcctctgaatttgtttctgtggagcttccatgccagtcagcttggccatatcatgttctattgccatgctagatgagaattttagacgttcaagaatactgagggagagaatttttttcaaattttttatttgcaatgaaacctttttttcccctcaaaagcaatcttatcagacaactaagtaagtataagaaagaagatctggatagtgagggtagaattctcaagaaccttacttaggctttccctttctcggccaagcccctgacttggaattcccccttactcccaaagctctgtaacccatatagtttcttctcctttatttcctctgtaaccctgatggctttctttcttttcttttcttttttctttttttttttttttgagatggagtctcgctctgtcacccaggctggagtgcagtggcacgatctcggctaactgcaacctccatcccccaggttcaagcaattctcctacctcagcctcctgaatagctgggattacaggcgcctgccacgacgcccagctaatttttgcatttttagtagagactggttttcactaccttggccaggctagtctcgaactcctgacctcaggcaatccgcccaccttggcctcccaaagtgctgggattacaggcatgagccaccgcgccggccgattgctttcttaaagtatggcttgcaaaccagtagtattatctaaggctctcttttcttttcttttctttcttttttttttttttttgagacagagtctcactctgtcacccaggctagagtgcaatggtgtgaccttggctcactggaaccttcacctcccaggttcaagtgattctcctgcctcagccttcctaatacgtgggattacaggcgcccgccaccatgcccaattaatttttgtatttctagtagaaacggggtttcaccctgttggccaggctggtctcaaactcctgacctcaggtgatccacctgtctcggcctcccaaagtgctgggagtacaggtgtgagccactgcacctggcctaaggctctcaacttgatagatgtgaaaactgaagtccagggttgtttgctgaatggtccaagctaacaacagggtagtggctgaactgtgacttataacccaggttttacagtcttgtctaatgtgccacatagtcccatttctacccttatagccctttacccccatcagtcttagagcttgaaggtgcaaagagaggcagttgtattaggcaggaccccacagggatgggcagataggtggctgtgttagcagactgaagtctctggtccaggattggagcctgatcatttttacattaactgggatcgtgaatttattcacttgcagccggtttatagatgatttataatgaagatgcctcttggttttcagtagggtacatacttttccagggcatatacttttatttgtctgctggtttacttaattgctggtagccccagctgctagcagtagtagtctaattcctgatagggcagtccagtgcacagaagggctccttgccgctctgctcggctcagtttttctgtagctcttaaactttctccccaccccacttaatagagtacatgttattgatttggaaactggtatcaaagctggtgggagaacgagatataccagtgaatataaaagtcaagaatgacacgtttcagctgcaagaatatagcttttttattaaaaagtttttgcaccgtgtattatctggcctttgtgggcagatggaagtgatgcccatcaatatagaatgtgtaatgatgtacacgtgcaaatatgctcctggctcttagaaacgttttgatgaagcgctcgagttcattcccatgcaggccaatgcatggattctgaaaataactgaaaattagtgtctcgttcctttcatcctcaccgattttctaaagaggccaccgcaaaggagagagcatgttccaccatgatggtcctgtttcacccagtgcgtgggggtgctccagatgtgagcagtatgaacgaagacaactttcctttgatgtgggacacaacttttaccaaccttccccaaacatatcttcctgtttcctgtgggattgtagtgtacacttgtttaatgattgctaaagtaatggagaaacaaatgtgaatctggcctgcatgcttcctttccttcctcagaaacaaagtggggctctggaatccttgctgtgcctgtggaatgtgtcaggaaacacaaccctgagttcattagttgagattggcagcaaagcagccttgggtctggtggagctgtggtagtaggggtccttctagtccttaccatggagagtggtcactctgttgctttcaaggtttcccaaagccggcatttgtattcataatgtcattttgtgcatttgggttattttcgccaagttcatagcagctgtaaataagaagatatttaagtctgtttttttttttttttttaagattagaggtatttctctgttttgtaacgcacatgttctcagtagggatttgtctgttgacagaatgagggctctctaaagaaacacatatattcaaggctcttcttaacatctacttcaggtctatctgccaggctagtgatgtgttttttgggatccttatccaccatgaaatctagtgttgcttgttctatatttgatgccatcttttaaagtaacaggctatgagtagtttgttgccgtccacatgtgcttttccagccattcaaaaccttttttttctaagacccaacatgcaccccttgattatttttgggttaccttattattcattgcacttatgcaggggcagtgggtccattcctgcggcattcctatgatatccaattatagtaactgtgtttgtgttgctcagttagaagttgaatgagctggagatttaatgatctagttaatcagtttataattggtaatcagaaagactgagggtttaatcagccagtgtgatatcatatgagccattggttcccagatgctggtccaacaaccacaagtattcacagatttctaggcccatctggggagattcttattcagtatgtctcaatatagactctaggaatctatcatttttcgaggttccatggaagtttctggtgcagggatgtcaaagtatgcatggtataatgactatgtcttttagtgataatgtttttcatctctgtgtgtctcagatactgctggaatgccttaactaccttctttaatggaatatgtttatatgggcattctgggctatgtgggagaaggaacctcaggctggccatcggggacctggttctagccttggttctgccactctctcaacctttcatcaggttagagaagtctaatctctgtgtaggtctaattcataaattgagagcatcagattatgcaaaaggcatttttcagctttctaacattcttcgaagagctttgcctccctaggaattgcttttgttgtcactgttcacgaacagctgttgcctcatttagtttagcgtgtgcctagcccctcaaccaaacatgaatcacggtctgcttctcaggagagctggtagctctccccgaattcaggatggcctcttttcctcttctgttactgccactaccaatcacccacaacaagaccaaagtacactgttttttttttgagacagagtctcactttgtcgcccaggctggaatgcagtggtatgatctcggctcactgcaacctctgccttctgggttcaagcaattctccttccacagcctcccaagtagctgggattacaggtgcatgccaccactcctggctaatttttgtatttttagtacagacggggttttaccatgttggccaggctggtctcaaactcctgacctcatgttatctgcccacctcgtcctcccaaagtgctgggattacaggcgagaaccaccgtgcccagcctgtattggggtttctgctaaagaaaattcacattgcagttctgacctttcgtataaaacctcagggttttttacccacagatccctttttgcaggcaagagatgcttgtctctttgggcgtaagatgtgactgatgtcatagtctagggagctgggcctgtactgcctcacccccttcaacaaacctttcatttccaggaacttgctgtagattgtctaggggggccagctgaggaggggggcagaacatggtaaccccttaaatctctggttgtcagccattgtggagcatcaaaatgatccatagtgcttttaaaattgtgcatgcccgtgtccccccagcaccacctgggccaattgaatcagactctccagtgtgggactggtcatgtgtgtgcgtctgtgcgtgtgcgtgtgtgtgtgcgtgtgtgtgtgtgtatttttgagacagggtcttgctctgttgcccaggctggtgtatggcatgatcatggctcactgcagcctcgacctcatggactcaaagtatcctcccacctcagtctcctgagtagctgggactacaggtgcgtgccactgcacctgtctgattttttaatttttattttcagtacagacatggtttcattattttgcccaggccagtcttgaactctggggctcaagcgatcctcccgctttggcctctcaaagccctgggattacaggtgtgagccaccatgttaggccaattttaaagactttactttagactctaccttccatgcactgtccctctgcattctgaaattattttttgttaagtcaggtataaataaattttcacggagagttgtcatgaaaatgcagtaaatggtggtctgaatctgttggaaatactgctttgagactaggaggccctcagaggctgaaggctgttcactttaacgttcccagcgtatggtttagagatggccaccactaaggatttacccccggtggtgcctgtctaccatggtttaatgcttcatcatggagaacaggaagtcattcatcgttttgtgaagtgaattttaacataattactcatttatcttctattcagtgcaatttaacaaatacgattgggaacttacaatgtactaagcattgatgtagatgctatgtagtgaactaaacagaattcctgccttcgtgggaatttctcttcaccaaaatatatatatattcacttggagtttcacacgactgaattaaatggctgcattatgaaataacattttagaagaatttttgaggattgacctgagttatccctaagatcacaaatggaatcagaaaatttggagtttagcatgtgaaacctggattaaattagcaaaatgttaaccaagggactgtgtcttactaatgcagcaaatagtcaggagtggtttggagaaatattttctgaaggtgaaatgaataaaccagtgggtataggactttgccccaaaaaagtcaaccaaggacattgacagaattaaagtttgtcctttgactttaaaaataagtcttcagagctgggtatggtggtgcctgcttgtagtcccagctacttgggaagctgaggcaggaggattgcctgagcccaggaggttgagactgtagtgagctatcattgtgctaccacattccagcttggaatctaaaatttaaaaaaaagaaagaaaaaaagtccccagagagtcatttgatagaaatcttttttgactctttttttttttttttttttttttagctccatgtattttatttcatgtatatgcaaatacctttgggccctggagttaccagtattttatgtttgtttcatctgatcaatgaaaacattaattagctgaatgcatatgtttcaggattctgggatgctacttcacaaattactgcagatttctatactcaccttaaatgggttaatatagcttccacggtgtctatttctgtattgtagtttatgcactgagattttttgattcagttatacatatgaacattttaaatgtgccttttaaagaatttaaatactcatatctttttgcatgtcttttttcctttttacaaaaggaagctatggtcgttttttttttttgttttttttttttttttttaccatgactgcattcttggattccaaatgtatgctaaaaaattcgtgagactgcaaaggcaaccaatgaaagaaaaacacatttgatatggatttcaaaatatcaagagaatctggaaaggaaaccaagatcagcttttggttgcagctcatatggctgtttgtgagttaactagcttagaagggaagtaaatagtttatgagagagaaaaagatagatattctggaaatcattattaagctgaaatttctgcatctaattttggaatgtttatgtttagaaagtcacatgcacaatgaaaatgtgtgtttcaggtttgtggagaaaaacagcgctttgagaagttgatggaacatttcaggaatgaagacaataacatagattttatggtgagttatttcagtattcaataaagcaaactcagtttcaatactttttttctaaatacacacacacacacacacacacacacacacacacacatatttatattacaaaggacagggaattgcaattaatatgctatagatccaatctagaatgtccctcttaatctgtatttctctttgatttccattttattccttacatacacggtatagtaaagacaaaagtactaatcatagcaaataaaggggaagccgtgcagttggaaacagccatgcctggtgcaaatgctgccattgtttaattgttgatgatgctgcataagaatccttaaggtagaagcaatcttgaccttttttatttttgcaggcccctgccagtgcccttctccagactatattcttaaaaattaaagtgctttggtttgtagagttgactgtatgtatctccaaaatgaatatgcagcagtgattttttttttcctccctgatctctttcctgctttggtaattctgtgagggtataatcatattggggctgtccttggcaggttaggtgacatacaagaacatgcggttccacagcagtcctgtcattctcgggtaagaacatcaaagtgagttgcagcacttctgcattcatacacgtaaatcttaatctggaaggaagatagaatctaccatagtgaatttctccagaagttttacgcttgagtgcacccagatctgtaggcgttgacccaatccagttgccctagggaaattctagacccaggagatcctaaccgggctgtaatttcccagatcacttctaacctgaagcagacgtaccaatgactccttaccttgcagagcctatgcttaggatgccaagtgaatttttcatttgaattgcttcagtgattataaaacatgaaacatagctttgcagatttctaaccctttttgtgaaaaaaaaaaagaaaaaaaaaaaaaaaaagtttggagtcctcaagttttatatgcgtcttagccctcagccccttccaaaaccagtgagaaagatgaaatcctttatagagaagattttctgttgcataaagcatgttatttgcttttcaaagtgtgtgtgtctatatatatatactttatatatatacatatatatgtatatatatgtgtctatatactttatatatatacacacacatatatgaaacaagggacatttttacactgacttttaaaatcttgttattaggattttttaaagaagttaaggctgatgctggccctggtgataaatacgtaaagagattggtgccttgtctcatgatgtgagtttctttcttgtgcctttttaggggaacttattcattctgttagagttgaggttgcaaactgtaggctttcatgctaaagccaacctacaggcttatgagttcagtctgacagtgatgaccctacttaaacaatttggacatgatgcataaaaaatacacatctgatttgcttggaaactgaaaatatttgagaacactaggcccctgttcctgcagagtgtcagctgctggagccaagcagcccctattgctttagtccaaagatgtcctctctagtttgtcacagtccacaccattccctttgcgtgacacacagcccagcctgctcatttatgatacctgccagacctccttgccatttgagtttctgctgaaattacaattatataaagccctttaaaacacctgtactatccatacacaaactaggttccattttctgtcagttcgtttattcacatatacatgcaatgaggtaccttatttagaggctgctattacacaagttctatgtgctagattcatgtgtcaccttcagatagttgcctcttaggcatatcataaaactcagtagatcatttagacctgttttccgaagagaaatggaaagatgccagaatctaaccatgttttctctccagaatatgaggcttttgataaactgccttgggaatgcaattaggttgcacaacctctgaaacaacatattcctcataacatataatataaatttttctaatgtagtataagacatttctaccctttttctgtatttttttgtggacaaaagaaaacaaaaaccattttgtttctttaaaaaatatttttctagtttgtattttgtacatgcctttgtaaagatatattttttaaagctcatttagtgatagaacccgagatgatttttatttttttatttttttttagtaagttgcagtagagtccttttgtaagctagagaggttacacatcttccaaagatatccaatgtataccatatcttcaaagaagaatctaacttgataaaaaaattttttaaaagataaaggaaattaggtttggagagagacaaggaataaggtggttctcaggataagtgtgactctgcatccctcaatcatattccctccttgccagagactctcctgggtgacagccatggagggaaagcattagtaagatgtttccaccataaatagactgatagtcactgtggaaagcaaaatagatctgttgaatgctgtccttttatttaccaaaccagggacaggttttctctttggcaggtctcagggccagtggtgaagttgtggggagaaagcagtaaatcccaggcttttagggaatgcaaactcgttgattatatggaaagatgggtcaaggatctgttactatcctgttgatagggaagagttcacagggaatttttagatgtggttaccttttggtgagattgtaggtgatttaaatgttcttctttaaaaaatgttctttgtaataattttcacattttgtacaacataactataataatttccacagtttatcttatatacctatatgactttcactgagatataattaacataccatcagattcatccaatttatttataatccagtgcctatttagcctattcacagggctgtacaatccttaccacaatttaggacacagcgtcacccccccagaaaaaagtcctgtacccattggcagtccctcccatttatcccaccctcagccctaggcaaccactaacctgctttctatctcaatagtttagcctgttcaggatgttttgtatgaatggaatcacacaacatgtggtcttctataacgggtttttatcatttaacatgttttcaagatcacgttgtaacatgtgttggtaatttattggtttttatggtttcataatattccattgtttggatataccacattttgtttatcgattaatggacattggcttctttctactttttggttgttattaatgatgttactctgaacatctgtgtaaagatttttatgtggacgtatattttcatttctcttaactgtatatctagaagcggaatcgctgggtcatatgataatgctgtgtttatcattttgagtaaaagtcacactttttaaagtggccacccttttttacattaccaccagcaatggatgagggttttaatttctccatatccttcccaacttttgttactgtatttcttttttattatagccatctgagtgggtgcgaagtggtgtcttattgtggtacctctgtgacttttgaatttaaaaataagtataaaatatttttaaagaggccgggcgcagtgggtcatgcctgtaatcccagcactttgggaggcccaggccggcggatcacgaggtcaggtgtttgagaccagcctggccagcatggtgaaaccccatctctactaaaaatacaaaaattagctgggcgtggtggcacctgcctgtaatcccagctactcgggaggccgaggcaggagaatcgcctgaacccaggaggcggaggttgcagtgagccgagatcatgccactgcactccagtctgggcgacagagcaagactccatttccaaaaaaaaccatatatatatttttaaagaaccaatgaaatgaaggaaaaggaaatcggtaagtgagccttttttatgaaattgaaagcacatgtctgcagttaaactgagaaaaaagtttggagcccatctaaccccttgacaatttcatttcaggtggcttctatgcagtttattaatattgtagtccattcagtagaagatatgaatttcagagttcacctgcagtatgaatttaccaaattaggcctggacgaatacttggacgtgagtatagctgtgacctttggctccaatataagaattgacttattattgcctgccctcaaaggtacgcttccatagcagctaaagaatgcctaaagctctatgcagtcaactactgtagtgctagttaaagggaactgagctgagtgatgtactctgccagagatgctggattcttgcagggctcctgggatctcaggtcatcttctgctagcagccttttagtacgggagtcagataacctcttgcagccttgctgcagctttcctctccttttgagcttcatctgggtcaagtctcattgcatccttcatctgggctattgggcaatttgtgttcttggttactccggggaccccatctgggcagagaaagtcaagccaagactgtagagtgatgagtcagtgcttagagcataaaaaaaaaataatgaggaaatggacaccagagacttcctcctgaagctgctaaattctgcttcaagtgtttgtggctttagaagttccacttttagttcttaggagaaggaggtttaaagtttccctttttctcactcccttgcagaagagtttagccagttccctgaagttcttcagttaagaaacagaaacttgtgaaaatcagaaatggtcttgaaaaggctgatggctcacacctgtaattccagcactttgggaggctgaggtggaggatcacttgagcctaggagttcaagaccaggctaggcaacatagtgagaccccatctatacaaaacaccaaaaaattagccaggtgtggtggtatgtgcccgtggccccagctgcttgggaagctgaagtggggggatcattggagtccaggatttctaggctgcaacaagctgtgattgcaccactgcactccagcttgggtggcagagcgagaccctgtgtctaaaacggaaaagaagtggacctgaggatccaggcagttttgttttcccttttgtataggaatggtctagtgatagagcaagaattgttgacctcaatttccttccttttttttgagacagggtttcactttgtcaaccaggctggagtgcagtggtgcaatcttggctcactgcaacctctgcttcctgggttcaagcgattctcatgcctcagcctcctgaatagctgggattacaggcactatgcctggctaatttttgtatttttagtagagactgggtttcaccatgttggctaggctagtctcatactcctgcctcaagtaatgcacccagccggtgacctgaatttcaagcctgtttccagctgtgaagaatatagaagtacttcctttgggcatctcaggaattcagttgcccatctttgttagagataaacccaagggattgcacagactgtaccctcagtttattaggagacggaatcacagaggtggttactctcaacctgaaggccttgcttcctagactggctgggctgcccttgaatagatgggcctactgttgtctaaagactactcagggagaggcgtaatagatttccattaaaatgttgtttgaattgctttcctttttatttaaaggctcatttatatcactggcagaatattgtacagaaagactctttcttactttgagatcaaggtttgtctatccctttttctcctatgctctaaaagtatcagtatttgaacaaaaattggatgtataaattcctagcggtgttttgggtttggttttgtggtgtctgagcagagcttgtttatgctgtagaatataacggcaggtacccacttatcactgaacacctgttattcattgtgaatctcatgaaaaatcccattaagctgcttctccttttgttctagcctttgcccttatttagaagccattctcacttgtgactcataaatgaaaacagaacactctctcttcagaataagctgtattgtagaattccagattaaacctaggggaaaatccatttttctgaaaatttatgtagagtggaatttctcttaaaaatgtaagattttttgtcaaaactctgtatttctttaacttcatcatgtgttgactctggaacctaatagaggtggttagaagagtaatgtaaatgtatgctatataaatgcttcactagtttacaaaaacccagccttgtaagtagccattgatttgttcaataaatgttgattggcatcatccatgcaccaggtattattctaatcactcatctgttccccagggaaagtcatgacttatgttacttgtagggaagattcactgatttatttgacctctaatttccagagctagctgagtccctgcaggatgcctagtttgggaggcagtgaattggggaaagctttctgatctgccttggggagccctgagctgttcatgctgtatactgacttagggagggatgtgtggaggttgggctctagcaatttgtgctaaaataatccccaaggctaagtataaactctgtcagtgtctgccccacctctcgcctaaccttcttcccctactggaaccactgtaactaaccaggtaagataccaaacactccagtcttttccactacacagatacccctcaggttttatgtggccatgactataacctgttaaagctgcttttaatttttctgttgtcccaatttcatgtatatcaaaatgttttacataggaatataactacatggggcagtaaggatttgggggaaaatgtgtgtgcatttgggagagcgtattcacccgaaagtcatctgatgatactgcttaggcagtcactccataattctcttaaggaagatgacatgttaagctctcttggaaagggctggactatttgtcgaaaagaaaacacatagactggctgggtgtggtggctcacgcctgtaatcccagcactttgggaggctgagccgggtggatcacgaggtcaggagatcgagaccatcctggccaacagggtgaaaccccgtctctactaaaaatacaaaaattagctgggtgtggtggcgcgtgcctgtaatcccagctacttgggaggctgagacacgagaatcgcttgaacccaggaggtgaaggttgcagtgagctgaaatcataccattccactccagcctgggtgacagagtgaaactccatctcaaaacaaaacaaaacaaaacaaaaaacaaaaaagacagactcttaggaaatgatgttctatttccatagatgagctaacaccacgttctctcctattctggtttttagaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatgtaactatatctcagaaaaggaaaaattgcttacatttcagctggttgcaaagcagaattaatgtcagcttttatggtggtaaatttaaggatttggagtataggaataggccataccctgcaagagagagctatcagaagctgttctgtgttttttccaaaaagcagatgtgttatgtaaaatgaaatagaatctgttgctttgctttagctcacttacctgctcagtttctgctgaggtgcatttcctggcagtcttgcttacaggctcaagcagagtgggggtgtttgatgattggcattacgtaaatgattagagggaaattaaatatgagaatttggcctgaggcgaagaggtatcttcttatcaactatgtccacacaaacccatggacaggattagctggtgtctctgtgatgcatgtctgaacattcctgtcttacggtactcaaattcttaatagagtcatttcaacaataggcattttcaaggacatcggtgtgctttctcatatatcctgttctttgaagaatgtcctcagtatcgttgtcagctctatcacaggacagggtctcatttttctttgagggatttttcttgccatagactgatttgaatatgactctaagggcctttagagattatttgttcattcattaaccacatatttcagtagtaaaagaattaacagaaaaatggtgcttctcaaaaacccaagcattatgaagaccaaattcttttggtgagtctggtgagcactttccttgattatgaaatgaagtgtctccttttggaggattattattttctcctttgaacagttcatttatttttctccacatgttttttaaagagtgctgcatatgctcagtttccttcacctttccccatcactgtgaaaatgggtctcttcatggctgtgggtaagccaagttggtgagccaaaaaccctccctttaaaagtgccgctatgacccagctggcatccgcttaaaaagagaattttacaggcccagtatatcttcccttagaagatttgtgttatatgctgaacccaatcagtgtaaatctccactcttcctccttaccttgcctccctggttttctttacttgtaatgaatttaaaggagatgttagaaatcagaagttgctcagtgttagagccctatgtgaaaagcagctgtttaacacatggctcaccctgtctttctcctgaagcctcagccaacattgcatgaccatacttacatgtccacttttgtagcagcaatctatttgaatggcctcccccaaataacttttattattattattatttttgtgggttttttttttttttttttttggagatagagtcttactctgtcacccaggctggagtgcagtggcgcgatcttggttcactgcaacctctgcctcctgggttcaagtgattctcctgcctcagcctccctggtagctgggattacaggtgtactccaccacacctggctaatttttgtattttttagtagagatggggtttcaccatgttggccaggctggtctcaaactcctgacctcaggtgatccgcccaccttggcctcccaaagtgctgggattacaggcgtggcaaccaacttttattacttgcatagtttggtcaaaccaagcagtagttgtttttcaactggctacctagattgaaagaaccaagtttactgtgttaccaattttcaaaagctttaggctgatggccctttcttggcatggagtgggggatggaggtggactttccctcctctttctccttactttcctctacccttgctagcccctgcagaaatggagggaggcacactgtgtatgttgaacactaaggagcagacatgtgggtcttattaagaatcatgtctaagttatcaattcctggtagaagcaaatatgtattcagaaccatattataaacattaccatttccagaaaacaacttgcggaacacatgcagggccctggtccctaataatcttggagctgcactttctgagaactgagggctgatcaagatgatcctgtattgtgacagctttcttttcaaaattttacagttatctgaaaaactgcaagacacagagaatgaagccatgtccaagattgtggaactggaaaagcaactcatgcagaggaacaaggagctggatgtcgttcgggtaagtgtaatgatgacaactgcccagatgggcacggtagggaatgtactccagctttcgtccagtggaacgcagagtaccttcatttcagaggaatgcattgatgcagcatatttattggaaacctttgagaggtgatgctcagttgaaaactacacatagtcggcgttatgtatacacatgtgtgtgcaatcagatactgggggttcagtatttccttatcacagattttgggagcaacagtgttttcccatctggaggaggctgagttaattctgtggaacacccatttggttggaaataaaaacacagcatggatttaattcatgccacttatttatttttattaggacttgagcttctttgtatttttttgctttgcttccactcaaaaccagatttggtggttgctgtgtaaacagtgaaatacaacacaggctaggcttaatggcattcaccaaaaaaagggaggggatgtgcaaagcaaacccaatccattttattatcagctaatcccagctattttatttggccttagtattgtttaccttatgtgccaggtatttatggagtgccatccctgtgcttggaattgtgctgaacataagaacaccaaaatgcctggagagctttaaggcaaatggcttgcctttacaccactgctaatgaaattgcaccttttatgtgatggttatcgtgtctgtgtgtgtctgatatcctgacatgtcctacagttcagtccaggaaatatattttctggcacgccttcgagacagagttgtagcatatggactcaattcaacttcagactcttagattattagtaatagacagggtgtgaagaatgtttccctgcttgctggaggtttgtggtgagagatcgcttgtacaaggcccagcaaggaagttcagttccataaaaccctttcactagaacctctatgggccccccccttataaaaggaaccaggacagtctttgaattgaaaattgtaacttctttgttttctgctaaaaagctagacagaaataagtaattagtgaagggaagctttggcctgttttgttaaccgcattaccgatgggaaaatgttacaacaatcgctatcctgagcttggtcaagggggcgttgtgagggccagagaaagccattcagaaacagtcagcccctggttactcatgagtagattattccatgctttgcagatttttaatcccagtctgatttgtatccaagtctgatttagggcccttttgtctattgttagctgatatgtgtatctaagagttacaaatgaatgttaaaataaaaggaaggaaaacatgcaccaccagaacaccctcaggagattccagagtcagcattccgggtcatttctgctctgtttctttccacctgcagggaaaattgagttagctgcatttattaaatggaaagaacttcattaccaacaacaatagctagaatatattacatgcattactagcatacaactaataattaatgggactttataggttctagctgaattccaaagaattcccattcatatgagtatctttttttctctttatcctcagtttgccaatctgatgctactaagtatgaatgttatgtgaagataaactcttgaccttggactttattgcaggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacaggtaagaagccttggcaggaggactgaggaagttttggaatatttgtatttcttcttttgccaactgtccacttctgtcctttgtccgtttttgttggcatgttctttaagaattggttttcttgagtagttcttaactgtttacattttgagattaaatttataaatcctcatttcacatatgttgaaatatttttcccacatgtcaatgaggacattttttggtttttgaaaacagtcctttgtccttttaagtgtgttgttttcagatggctttatatgcacatggcttattgcaggaaagccattcccgtattttcaaagtccatctgtttcttttttctttgctagtgcaaaatggtccagtaacaccacctatgccaccgccgccgccgccccctcctccacctcctcctcccccaccgccccctccgcctcctcctctcccaggccctgcagctgagactgtaccagctcctcccttagcacctccccttccctctgcacctccgctgcctggaacatcttcacccacagtggttttcaactcaggattagcaggtaagagcacagaattcaaacccaggtactcatatcagaaatgctgtcttatctcggagagttgaagctattctttcaaagtccaggtctcttgcaatgatgtgtatctcttcctagtataagaaattcctgctgatgtagccgatagagggaacatcatcacgcatgggaggcactttgctctgagtagtctttgtcacaaccacaccccacaatgggaggttctgatctcctacaccatcttcctgccttccactggccccaccgagagaatggaagagagacaagctacctgcttgaggatcagtgcatttttgtgggttcagcagatactttctggacacctgtagtattcaaagctcagtattaggcacagacattgagtgcttctggatctttttttttttaaatggtatttttgatgtcatctataaaagggaaacatgcttttatgtgtaattgcctgacgtaggcttccaggcatgtcttctgagcattcgagaacatcagaatttgctagagtggatttaaacttcaaggaggaagtgctgccaacagccgtattatcatgccttaaaatgctgccaaataattcatgtcctcttgccaaccagaagatagaaaacagcatcctcacctcaccagaaataaaatgggaggtaggggttagagcaggaggaagagtcactctaatgccttgaaatctaagctctttgttttgactcacggaaacaaagatgacgctacgagccgttttctcagtcctgaagtgtttccctggcatctggaattgctctaagctttgccatccctgtgacgtggggtaattctgcctcctcatttacttcagcctgttcatgaggtctcttatttacaataaagaactaccactctaatagcctccatttccaaggctgtgatagttctcagagccttttgcccaaagtctaaaagccagtcttagctgtaaagatttcccaatctccatcccttccaggatcccatctgcagctctgccagccggtcactggggctcattcatcccaatgactggagcccttttggatgccccagagtcacctagaataaattcactccacatcaaatccatggttttacttccaccccgacttctatataaaactgtcagggaaacaagattccagttcacagtaaggtccacagtaaatcggtgacttatttctacccttcaagatcttccccgtctaccactttcttctagaacttttattacttctgaaggagaaaagttggagcagagtcatcgtggaactgatggactatggaatataaacagacaaacaagaaacctcatatcaagccccgggaatgtgttccatcaccaggctgttgtcagtaactgggtgtggaaacccattatcgtcccgtgcacctggccaccctgattaggcactcttggtagcccccaaggcgcacttgctgtgagatgtgtctgctgtggtatctcatttggggctgcttcctttgtctctgacaaacgctgatgtgtgatttagcacccacttccacgcacctgagcactaacatagacctcagaaccgccttagccgagtgagagcccagaggctgagatgtgtctagagcttccttccaaggggccatgtcctgtgtgattgatctatttattaattgttttgcttgggttcttcccactacttgattttaaaaatgtgttggctctgtcaattgcctcaatattttaaggtgtagagctctgtgcttggctgataaccaactgcttttagggtttgctatacttggaagtggtccctgttgtggctcatgcaatttagaggactgtaggtgggaatacaggaactctttatttccataagtgtccactaaatgattgtgagggatgtcttggaagcattataagatccttgtgagtctttgatagctcgagatcaggcaatttctccaaggcctttaatctttctttattattcatccttatttagactgttaattcttagtgattgaagcccatttggtgagatgttttgctagtgtgttgagtaactctctctctcactctggaaccaagaggccagacagaatcaggatgcccagtagaatgaagagacagagctgagctaatattctgaagcctcctgggaagtcagaaacctatgacatcacttggcctctggacccacaggcaacacgagggtcttatctcttcaatgggcaggtgtgttcttggagaccaagacagaagaccaagaggagagccccatagtttatctagttgagagttttctttgtattttatagagaaaatagtagtagtgtgaaatatgcatttgaagaagaaggcttccttcctctcaagtctgtgatagaacaacctggctccctttcccccggtaggtcacctgagacaggctgctgagcaggtggaacctttgccgtctgtctgggaggatgtgctcggatcctcacaatgcgaatttggactttggttgattgtttttcatgtaaaaattattcctatcctatggaatgcctagcacagttcagtattgctgtttggtaccactacgatgaaataatttttttcttccctcttctaaaaaggataattttaaaaatgaaatagttgagtcttggaggcaggcctgaatggaaatgaatttttggctctgtgccgccttgtgaaatgtgtccaagaagcatgaaattctatgctgagtgcgtgaactgctgagccacttgactctaaccatatctaattttttttgtattttctctgttctttctgcttccacaaaagatgggccaatcaagcttttctgtaggttgctcctcactgagtgtgttgagtatttgccatgtgtttctgttggtcacactgtgccttgacatctttccactccattttgctttgatccattgcattttgactttgtgtctgcgggaagtcttggtggtggctgatgatgattccaggtttgcccacacattctagttgaacctacataagagactattgtccttgaagcagacatcctggattcatatgccctcttccatttcctctgagaaaaggtttttttttttttttcttcttcttcttttaatttttatatttgtatctgagacttcaactctaagaacaaaaaaaaggtgccaggtgccccttttccattccctccctcatgctggtctctggcccactccagggagcactcacccgcctttagcccgagccatggggacacagtgtgtccagtggtcacctatgtgctttcctcctcttcccactcccaccctggttaaagccaggaaaacctttccaaggaggagaactttcttgcctgtgttctgatctcaggcttattcctgaccttgctaaatagttagaagggtggttgcaaatggcaaacttctagcgagcgtcatgagcctaccatgtctgtgggaggaaggtaggacgccattggcaccaacctgtcacctcaggttatgaaaagactcctctgcggcccttctgctgctccccagatccctaacattgccgaagtgccagaggcaatgctagggcaagtgctagaggaaagtctgttcctttgtcccatcgagaacatctgttttcctgggtagcgtagacaaaatgctgtacggtgaggaatctgacactgtggcgtagtggggacaaaggtgtcatgtttggtggtggagaggcctggtttggctaaagctgtgtctgtttttctgcatgcttttgtgtggatttatcagatgacattcctgctgtttaaatggcctttgtaactctggaggaatgagaggcactgtctgtctcagttaacgccaactgaggcaggcaggcaggcagccagctacaagcttagtcgtgtgttgcttttattttgttctgcactgaagcgctgaagttctcctccctgtcttgctaataatgacaaatagtgaagctcccaagtagtgtggtaggctacccagaacagactgacgaagctgaatgtgtatggctaaatggtttgggaagacttctttatgatatataatagataaatataattttaaatggattaccttttttggcatattcccgcacagtgagaggagttggcactccccatagtcccttaaagatacatcccattctctctattaagaggttttcagtatttttaatgagtgtgtagatacctcctagtcaaacacagctgactcctgggaagaacttgcttttcaaaatgaagggcaagggactgtggctatttctgagtctgagaatccatacaattccttcccttccctcccctcccctcccctcccctcccctccactcaattcccttcgcctcccctcccctcccttcccttcccttccttcccatctcaaaaaagaggagtttcctcccttcctcccttccttcctcttttttgagatggagtttcgctcttgttacccaggctagagtgctatggcgtgatctcggtgcactgcaacctctgcctcccgggttcaagcgattctcctgcctcagccttccgagtagctaggattataggtgcacaccaccacaactggctaatttgtgtatttttagtagagacagggtttcaccatgttggccaggctggtcttgaacttctgacctcaggtgatccacctgccttggcctcccaaagtgctaggactttgagccaccacgcccagcaatttcttttccttcccccccgccccttttatttatttatttttaagacagagtcttggtctgtatgtaccccttttttcactctgttgtcttaaacattttcttaggctgggcaagatggctcacgcctgtaatcccagcactctgggaggccgagtggggaagctcgcttgagttcaggagtttgagaccagcctgggcaacatgtgaaactctgtctctacaataaatataaaaattagccaggcatggtggcacacagctgtggttccagctacttggaggctgaggtgggaggattgcccgagcctgggaggtcaaggctgcagcgagccatgattgcggcactgcactgcagcccgggtgacagagcaagacctcaaaacctattttctcatttaggccattcatatcccttagtctgcttgaaataacccagcagccaatatatcttcattatcggaatcacccacaggaagtcagccttcatgacgttgtacttctggtagtctagtcagccactgtctgcagtccctgatcatcttctaaggtttgtttgtaaacatgtggtctgcaaccaagaatttaggatgtccaaatatggcaagtttttgccctctctgctatctagtaacatgagtaataatctttgctctccaacactttttatttgtcccaaccattgtcctaatattgtaactgtaatgcagcaaattagttgcctgagttaaaagaaaaaaaaaaatcaacccttggcccttaagacgtcttttaatacaatgatgtgttagtcaaccaaatgatgacctcaaatggctctggccaaggccatgtgtgttgttttccagctttaaaaacctacttgcgcgcctcttgccaaccttcctccagtgtcaaagtgtcatctgcaaggactgttgtctgattgttcctgagggtcgtaggcttttggtgggatcttaattccattctctttgatgtctttagctgtgaaaattaagaagccaatcaagacgaagttcagaatgccagtgtttaactgggttgctctgaagcccaatcagatcaatggcacagtcttcaatgaaattgatgatgagcgaattctggaggtatttttctcattggttagaaactagaggtgcactctgtgcagcaaagccggcatgggtgttctgttaacctggaagtgtcagagataaagtactagtgttttaagtcccctgatgtaaagaagaaacatgtatgtaatattggagaataacatttgacactgttttgtaaggtggctctaaaactgttcaaagagttatgttaaattggaataaatgcttttgagcatctttagtgtatgccacagaatatagatctgacataataattccttcccttaattgagagaaagacataaaaacttttggactgcaagtgagctcaattatcacactcactgccttatctgatggataattttaatctgtggcagctgtctgtgcaagctaattattgaaaagtaattgaattagtgggttagaatcggtagtctaatgttcacttatttttttattttattttatttttaaattattattattattattttttgagacggagtctcactctgtcgcccaggctggaatgcagtggcgcaacctcggctcactgcaacctcttcctcctaggttcaagcaattctctggcttagcctcccaagtagctgagattacaggcacacactaccatgtctggctattctttgtgtttttagtagagagcgcatttcatcatgttggccaggctggtctcaaactcctgaccttaagtgatccacccgccttggcctcccaaagtgctgggattacaggcataagccaccacatccgacctatgttcacttttgtgtatgtgccagaagttgtactataacaaaaacaagaaaaatagaggaagccatggccaaagacaagtacttaatagaaaaagtgacgtttttgcttaagaaactaactggtggcttccggacttcatttttaaatataatccaattttccatggtcattcctctctatcttaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtgtaagttcaggaaaattatattctagttagtttatgataaaatgaaaatgagaaagttatgaattagtagatgacaaatatttcaatagtgagacaagacctaagataaaagctggagcaatttttgatatccacacttgagagatctgaactctgtgtgtgctacttcaaagttgaatatgatgccaacacgaaagaggtagaccagaaatcaccctggggagtgttgtattagaaccagtaactaattgttttagaagaataacatctggattgtgacatcatttattatctgggtctactctcttatgcgggcctccagcaatgcttacataaaaggaaagttgagctgagcgtggcagatgttaagaaaaggtagaaaatgtcagttttctctggagtatctggattttatccagatttgttgaatacaaatttgatggcatttgtggaatgatacagttcaatgccagatgcaaatatgatacagatgcatattttaattcgtaacaacaggaatgtgaattgttttgctttcagtactttcaggacattttaaacaaagttcattttttactcttgaactgcatagaaggcattggttttactcctctattagaagaatccttctattcttcttgtggccatggtgactttcaaatgtgatgaagacattattaaatgttttaggaactaattatttataaattgattatcttatacattttggttagaggcttcgaggtgtaaatgaccctaagaaatcctttgttccaattttgtgtcctcaaccagggtcataatctggtagtccagtgcctcctacagtctgttctgatttctgtcattgaatcctgaagtgcagcctggctttaaatctttatatatcttgtttgtcatgatgattaaatgtaattctattatttagctgaacaaagattgtccagagaataatagagaatagagactgtaacaaatacttcatttgttcaaattaagcatatatccaaaaagaacttcaaggaatgtatgcacttaacctaaaacattcaataatacaggcatttggatgcatttttttccaaagaagaaaaaatactaccagactattggtttaattgaaatattttacataattcaccagatattctgtactaatgtgtacagtgttaatctcctgaattagctgtacttcacaatgcctgtcaactatgtgcttgaaccatgaaaccatcagatgctttggccttggttctacctcttcctattttcatttactcctgattccagaggcttagagctatgccagtaccctaaaaactgaggatggcagttgtgacaaggtccacgttttcaggaagaaccagttaagttacctgaggcatagtcaagaaccagcaccagggtgggacttcacaggacagctggagaaatcttagactcgttgatttggtgtttgatgagctgtaccagatggatgatggatggatgaacctgaaaagatggatgaacttgaaaagggggtaggaggtttttctctctaatgctaatctctccacatctgtctttagatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctgtgagtggactgactctggcaggggagggggtccaaagaaatgtggaatcgttattttttaaagtctctcccagaatcgtactcagtgtgatgggttctaaagactccttcccagaactttctaaattgcatttttatttcaaccatcttttccacattatgtatgcaaagtaaatttgaaaaatggggaatgttcatattccatattgccattcttccgaaagaatgccattttttgtgtctacagatgttctctagatttcaaaaggacaggggacaaagaaacttggttcttttctcaaacttggttcctctctgaagatactagtcttctggcagtgttggcaagactgaaaataagactttcatttctaaaaatgttgcctcatctttagtgagcagacttacaagcttttgctgaaagctttatatttaccataagagttttctttcttggaagtttgttataataaactgtggtgatatagacataatagccaaccatctctcattcccttgtgttaatctggtggagatttatgaatatcataaacttcagttctctcccaattctgtttctaaatagactttgttactgattatagtagtcagttctttcccaattctgtttctagataaatttgttggtttctgcttatagtagtatgtctgttgaaaacatgttctgagaacttctggagggtgttatattcccctcccttttttttcatttttgatgcctccttcattgatttaaaaatattaattgtatgacatgattagaggtggtaggcaggaaattgagttctaccagaagcagctgtggactcttaactctgagtcttagtggttgtagattggttacagattttgtgataagcaagttcctatgttacttgctattgtgaacagtttcagtaaagatcgtgcatgtaacaatattacctgagacctagcaagacaattaaatttgttatacttagaaaaagtagactctcaccatgaagcctgtatgctctaaatgcaggcctgttttcttctgtcttaatatttacttgccaattagtttcccatttttaacatgtcttttttcccctttttctttctttgattggaatctagcaactacatgcgattatagcagcatctgtctctataaagtcgtcccaaaaactcaagaaaattctggaggcaagtgcagtttttcttgtaggtatgaaggactacttcagctgcgttcagtgcctgatgtgctgtactgatgggcttctgttttcaccttcttttgcagatcatcttagcccttggaaactacatgaatagcagtaaaagaggagcagtttatggatttaaacttcagagtttagatctggtgagtggactaaaagaaatttgagagctgtttgaaggacagatggctggcagagatgaagttagggtggtggaggatgttttgatgaatattttctgctatgggaggatcaactggtactaattttctggaacaccatttgacagagagcacatagaacctataattactcataccctttgactcagtatttccatttctaggaattttttctcaagtgtctgaattttgaatcctgtattttatttataattgcaaattaacaatctaaaggtctaactgtgggaatgattaaatgtgctgtaacactagttaatacagtgaactattattcttccaccgttagcatactgatgaagagtgtcccaagaaagatttgtgtttagaaaagaaagcagggtatgctttgcatgtacagttgaatctcagctaagtaaactatgtggggagaaagactgaatggaaataggttaaaatattagcagaggttggatggaatcaggaaattttttcaaactgctttttgtaagtacttttctatattttcttaaatttttgttgttgttgttgcatgcagggtgctctaattttcagagtcacctaactaatgtgaataagactagagaaaatcctccgtggactccctccagactgtgcaggcctaacgtgattgtcacatgagaaggctgggcagtgggttgagtcccccgaccagggagctagttatttaatatggagtgtctagtcagtcacagttctggcctccagcagatcatgatcagttaagcatgtctgtttcaggtcttcacaggctaggaaataagggagggcctaagctaaatgtaaaaactggagcataggagccctgctgtgtaggaggcacctgcatgcacctgctggctgtacatccccatttctcctctggctttttactttgaagagcactaaaattagagccgtcctgcttttaaggcaaggaaggtgggatagcagatgcagggctgggagagttcatgtaatcagtgtcccccttatccatgggggctgtgatccaagacccccagtggatgcctgaaacctcagatagtactgaatcctatatatacactgttttttttctagagatgcatatctgttataaagttgaatttataaattaggcacagtgagagattcacaataactaaaaaataaaataggccaggcctggtggctcacacctgtaatcccagcactttgggaggctgaggcgggaggatcacctgaggtcaggagtttgagagcagcctggccaacatggcgaaaccctgtctctactaaaaataggaaaattagctgggctaatttttgggtcacaggcacctgtaatcccagctactcgggaggctgaggcaggagaatcgcttgaacgcaggaggtggagtttgtagtgagccaagattgtgccactgcactccaccctgggcgacagaacgagactccatctcaaaaaaaaaaaaaaaaaaaaaaatagagcagttaaataaaacacgttacttgaacacaaacactgcaataggcggcagttaacctgataacccagatggctactaagtgattaatggcaggtaatgattacagcgtggatccacttgacaaaggggtgattctcggtctagggtggatgggaatggcacgtgcgaggttttatcatgctgctcagagtggtgcgcaattcaaatctgatgaattgtttatttctggaattttccacttagtatttttggatacctgaaacctgtgggtttcctgaaaccatgggaagtaaacctgtgggtaaataggaactactgtagaggaaagctgcgaatcattcttaggtgcttagagtcatccctatagttaagcatgtgccctggttggaaagtccttgagccagttaagcatcaatggactggttcactaaggaacaaatggaatcctgaccctcctctgggaatgctccagcctgttgggcgactgttactcagttaatgactctgggtgggaaatcgtcacctgaggggtaagtgtcttgttaccctttactcttgtacctaacccacgttcccttttgttttcagctcttagatacaaagtcaacagacagaaagcaaacactgttgcactatatatccaatgtggtgaaagaaaaatatcaccaagtgtccctgttttataatgagcttcattatgtggaaaaagctgctgcaggtacttgatttcagctattaccgttcgtcttgggtatttaatgcctttaattgtggtggagccattccctgcttaaacacttttcagaacccatttaaaaagccaaggctaagaagtcagacacactgagctggaacacatcggccgtggtgttgtccacccctgagagcagaagagcacatgggtgtaaaggtgatctctgtgtcctttctgtaagacacaggccactgagcgtcatgtcccttccctcttttattcactgccctttttattctgctgctattgtatgaaatgtgagaatgagaatctgagaatcatcacccaacaaacacttttaatttgattttgtgccattctacttgctcaagtgtggcagttgtaaacattttgcctttgcctggacactagttaaattattagcacttcttggttgctactttgctaagacagttatacattttgtcatttaaatcatctgtgactctaagatagctgggatgtacaaggtaatagtatctccattattataggtgagaaaattgagatttttcgaggttaaatgtcttgcccaaagtcacatgagtagaaagtgatagaaacaggactagaaacctggtcttacttctcatgaagtgtattatccaatgtaccatgttccctcaaaagcatattcgattagcaaaaggaatgatatgcagattgaccttacagtcatttataggctgtgattctcaaattgtgatatcgaaccataagcagccagtgtttattataaattcagattcctgtggggtacctcaggcatctggaattttggagggtgaggccttctctaactcagccatggtaaatggctgctgcttctgtgttctcactaaagaacactctggtctaccctctcgtacaagatttctcatactgtattacaacaatttgcatgtccattgcaatctgtgctcttctttttttttttttttagacagggtcttgctctgtggcccatgctacagtgcagtgacatgatcacagctcactgcagtcctgacctcccaggctgaaacgatcctcccacctcagcctcctgaggagctgggaccacaggcacacaccactatgcccagctaatttttaaaatttttgtagagatggggtctccctgtgttgcctaggctggtcttgaattcctgggctcaagtgatcctctcgcctcagcctcctaaagtgctgggagtacaggtgtgagttaccatgcctggccaatctgtgcacttcttaagggtatatcaggttttatttatctttctatttctctcagcccctgaaaattggatgttggaaataaatgaatgaacaagtgaacaaatgaatgaatgagatgatgcactgttacagggacaaatgctgcagaagctgtggtggagactgagaggcagatggagatgactctctgactatgaagaactatatgacgcaggctggatagacctagagcaagttcggggctcacttagacagtaggcagaatttctgttctgaccaaatgattttcctccttttaagtttccctttgcctaaattaattacacctcacaattctaattaagaaaaatgttaaaaagctattataatttctacctgaccaatgggtactaattcattttgtttggtccaaatggtgtcatttgaaaaacatcggtggggaaaatgggagactgggttgctccctggcagaactgttctttctgtttgctctctggtgcccaggttgcccaacacagattctgtattccttcactcatgtgttcactcactccttcatttatccagtgaacacctttgagtgccctccatgtacttggcactatcataagtattagagaatcaaggatgataagacagtgtgagtctactgagggaaaaacctactgcactgttttagtaggttggtgcaaaagcaactgtgattttggaccgtgaattatcaatcattataactaggctcaaacatctttattatggccgggtgcggtagctcatgtaatcctagcactttgggaggctgaggcgggcggatcacttgaggtcaggagtttgagaccagcgtggccaacatagcgaaaccctgtctctactaaaaatacaaaaattagctgggcatggtggcacatgcctgtactcccagctacttgggaggctgaggcaggagaattgcttgaacccgggaggcagaggttgcagtgagctgagactgtaccacttcactccagcctgggtgaaaagagcgagactccgtctcaaaaacaaacaaacaaaatacatctttagtaatcaaaacaggaaccattaagatcaacacatttttgccaatgagaaataagtttgtttattcctgtagtgaaaaaaatctgtgcttctagattcaacaactcttggaaagcattttccgcatcctgctggttgtggaagcattttccctgcaaaaagttgtcgagatgcttgaaaaagtggtagtcggttggcaagaggtcaggtgaatatggcggatgaggcaaagcttcatagcccaatttgttcaacttttcaagcgttggttgtgcaatgtgcagttgggtgttgtcgtggagaactggaccctttctcttgaccaatgctagctacaggcgttgctgtttggggtgcatctcattgatttgctgagcatacttctcagatgtaatggtttcgctggaattcagaaagctgtagtggatcagaccagcagcagaccaccaaatggtgaccatgacttcttttttttttgatgcaagtttggctttgggaagtgctttggagctgcttcttggtccaaccactgagctggtcattgctgattctcatataaaatccattttttgttgcatgtcataatctgattgagaaatggttcgttgtgtagaagaggagaagatgacacttgaaagcaacgattttttaaaaagttttctctcagcttataaggcacccacttaccaagctttttcacctttcaaatttgctttaaaagactgtagaatggttgatgttgagttcttcagcagcttcttgtgtggttccaagaggatcagcttcgatgattgctctcagttggccattgtcaacttctgatggccggccactaagctcttcatcttcaaggctctcgtgtcctttgcaaaacttcctgaaccaccaaatgcattgccaaatgcattgttgatgttgcgagttgtcttcactgctttacaacccgttttgaactcaaataagaaaattgcttgaatttgctttttgtctaacgtcatttccgtagtctaaaataaatacaaacagcaagttaatacgtcattagcaaaaaaagtgagaagtgtgcattaaaatgatgtataacataaccacattgatttaagaatgtattccaatatcaaacagcagatttcagcaaatactgcagttacttttgcaccaataatttgtccacgtgcagagttgagtcaggcaagggggcccagagctggtactcaacgtcctaaagaagctgctcaggaggctgtgggggagtgcctgccccgggaggggccacactgcagacagaaaggttcacactaaaccttgctgaatagggaggggttgttagctgtgcaaggctgctttgggtcctagtaatcaatacaacctatggtcaaccgacaaaaggctgccccctgctggagagtcagagaaatgcaaaaagagttgtaatcccaacactttggaaagtcggggcaggagtttgaaggtgcagtgagctatgatggaaccactgcactccagcctggatgacattgtgaaaccttgtctctaaaacacacaaaaccttaggcttgctgcagataaggacctctgagcctacgggcccacccataggctattcttgtaagagaaatggaatagttttgtgcaagtgtgggatttagagtccacatttgttacctgaactcctctgccacctactagcagtgtgaccaagggcaggccacagaacctctttatgctgcttttgctcattgacaaaatgagctaatgatgcaaatgaactagtgcatgcaaagaatgtaatgtagtgcttataatgcttctttgcattaaaagatctctgtgccaaaagctggaagctaggtttagggcccttgagtaagcctaagaatctcctgagaacttggcccagcagccagattcgctgtggttgtgacttccccattgagtttcactgggatgttctttctctgctttagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggcaagtattggtgcccctgaaacctgtgaagaggctgcatccattaaagctgcctgtggtgcaggccctgtatttggggagaaatgttccatttccctctgtttgtggagggtagctttcttgttgtaactattatttattacggggggaccattcccagggttattcttggaagggccccgtcctcattgtccttttctaatctggggctctttaccctgtcccctccccctcccctttcacttcaatactcactccagtgtgggtgctgtattcagttcagcccacatgcgtcaggcctgtgctcggcaaagcagtgtttcctgtgtagtgggtttctgtagatcttgtccttgaaaatcttacactatactgggggttgctgatagataggcaggcctgcaaaacagaatgaacagtacgctatcagaagaggcagaggcaaagttgggggatggggactcagaaagcagattcagtggaagggcctctggtttggggcaatcttgtatcatggaagagttcaggcagagactgagtgtcccctgtgtgaggctgtcatagggagtgttgaagcaaggaagtggaatttagggtcagagtgaccaagatcccttttgaccttgttggttttaaggggttctgccacggcctttggaaactcctgtaagaaagatttccttgttttgtatgtggggtgtgtgcgtgtgcatgcatgcatgtatgcctgtgtgtagaagtggcaggaggtcctgcagatgaattcctgtgccccactattgcattcctcggattgcctctgctgaggcgtttggaggaaacacggaggcgttaggcaatcttgggaggtaagggaggtgcagcaacgcaaggccatgggagcctctgtcttgtggctgctgctttgcatcagcgttccccctagagcatccagttcaaatgcctaactaatgaaactcaagaaaaatttgcttcttcacaggatgcctttgatgatgttgtgaagtattttggagaaaaccccaagacaacaccaccctctgtcttctttcctgtctttgtccggtttgtgaaagcatataaggtatatgttaaggccctccttgcccttatttctcaagcaattgccctccttgagatgtgtctgagtcccaactctctgcagaggcctcccagttcctgtggacagcagatctgggtggcattcacgagatagcagtccctagctctgtggaggctgagggacattatggtccctttctccacctagccagtcctctgcctcagccagaaaacaaagctcttggcagcccccttggggcaagggagatgctcaaagacattgctgccccattgactgttcacctaggcaggcaaggtgaagtacttgaaaatccaggcctcttgtggaattctttaatgggtagaagtgagctgtgggctgtggtgaaggtgcatgatacagctgaagttaaggagagcctgcttgtgtaagtcatagcacagggcttaggacctcttagaccagcatttctctagtatggactaaaggatggtgcttttaaggatgggcactctctgtttctttgtgtggatcagtaagtggcccttcctttaaatgggaggccctcttggacataatccagggctgtggtcttgaaaaagcctatgacgcaaagagacatgtatcagaaggatttgtccatttgagaaattacaagaaggctgttagaagattttagctgaccttggcaacacctcaatctatatcctccaggcgtatcttcatgtagcactgataacactggtggaggtaggaggaatgtttattgcagaggggaggagggatgtggcagggttctccacacttttgagaagtcctgttggaaatagggggacacttccctaacaccactaggggctgaaggctctggaaaatcattattgggccttttactaaaactcagaaagtcaaaatattcttagcccatcttccctcagcatggcttaatgtagcagtagagctataagctgctggtagaaggaacgtctgtggcagtcagggtgaacagaaacacagcacaaactccgtgtgccagactcaggatttgctcgtgatgagaaggctgcgggccaccaactgctgccgtctgcagtgcttggtagcccaagcccactggctggctgtgtttatgtgctgtagagatagtctgcgatggcccttgtcatgtgctgtgccatttttttcacataaaaacatgtaagtctaaggtcaaaagagaaaatatattttaaaatcggctaagacaggttgggaagtggctggggtttgtctcaaagcctgaggcatcagcagggatatgcgtggagcagaggaaaaaagaagctgcccttggtggtctgggctgtgttggaggtcccagcctgtccatcagcgtgctccttccacctcactgttcctccctgtgatttttcacagctgattcagtgaagcatgtgccaggcagtgatgtgactgccaggatgtttttcttgccctatacgtgatgaatagcctcctagcctggcactcacctagggactttgtaggcagaggttggggttttaggacatcatccctctcatatagaccaaaatgaaaacaaaagcaatggagacccaaatgtaaactttattactgataacagctgggctggaggatgtggtgtctgtgaccttctgcttcagctgcaaattaggtagatgacctgtccatcagttcacagcttgacaactagaggtctcttcggggaggccggcttcaaaagaaagagtgcccaagagggctgagctgaggtgagcctattcactttcttctagattcatcagactagtcacactgccttccttgggaaggagcaaggcatgggagagtccaagagtgtcactctggtgaggccccgaaaagaaatgagggttttcccctaacaataggcagaaggcagaagaatcttagatcctgctatcagaggaactctaggtaggcagactgtctctgaaaggaaaacaaaatcactgagcacagctgccaggatggtaggtgcccaccagtgtgtgggacagagactaagagaaagttcaaacagggagcgatcatcaggaaaggacttctggatgaattgaatctcagctcccagcttttaaagagatgtgacaggtagcgaagcccagaagcagagctaaatacaggcataaagtgtagatcttctcaaccttccatttattgtaattctcaactcactaaggatgcttgaagaatgactttaaaaaatcttggctgctctcatttccattaacatcatctttctggttcttttgatttacccagcaagcagaagaggaaaatgagctgaggaaaaagcaggaacaagctctcatggaaaaactcctagagcaagaagctctgatggagcagcaggatccaaaggtaagaagtgccgcactcatgagacaggtccgtgaggagaggctgagagggctcttcagagcaagccatacaaaggaccagcaagccaggtgtgcccaggatcctgaccacttccttctggtgcctggacacttggcaaatggaaatatgctcattgattactttgttctgcaaccactggaatgaggctaagagcatgtttgtgtagcatatccaagcgtatagacatctggaacttagttggatatacagagaggccacaccagatgacccagtgaccagagggcttagcatccagagaaggctttatgcagatgcccattggtgctggccttgatagctggagggacttgctagcaggaatggagggaacatttcatggagggcaacctcgttagtaggtaaagagcataaaggctggcagtccaaagttttcttcattgtgatccttggcaacacagtttaagacatctatggtcattaccagttgcctcttgttgccgtagactccagccttcttgttgctgccaggtgaagttttgtgtgttcgtcagtggaagtttttgtttccttcccagaagcttgagttctctgcaactgagcagaatgtgggatgtgtgtgtgtttttggccgaagctgcttattagtaacataatgctcaggcacattttggattttcacaaactcctaatgggtgctggcctcactaatctctgcccttctttcttctcagtctccttctcataaatcaaagaggcagcagcaagagttaattgcagaattaagaagacgacaagttaaagataacagacatgtatatgagggaaaagatggtgccattgaagatattatcacaggtaaaagatatttcttcactgtggcccatggagatcccactggcctcacctagactgggatgcatgcagattttgcagcttcttttgtccagggttgtcaagttcattagttgactttattcacacccagagtgatgcagagaggctttgaagtccatttacagcagcatgtatactgccccaatactctgcattggaaccctgtaagtttcagcagagctccttcatttaaaggatttccattgttattgatatgtcatcatgctccattttttttttcctcgtggccacacctagccacctgcctgattaataaacactgtggacaagacccattcagcaatgtactaatcacagtccatggatgctctttaagagcctctttactcattcaaagtaactgaagtcagtaggtactttaatttgggtgagccaacaggcttccagcccagggttgggaactggttttatcagccaagaattgtgttaacccagcctggttcctgtctgattgaattagcataatgctatctcctcgaaccaattctcccaaatttctgtacttccttttacagatcagagtaataacttgggcactagtaggagaggcagcaagtgacttttccttcatgtctgttgcacatgaatgttgcttataagcttccagatgcttatagctttttataatgggacagtccaataatatgcagatgtactgaaaatagtatgatgaggtcccatgtatccctcatccatttcaacaattacgaactcatggccaatcttgttacatgtacactctacctacccccatatccaacccttgacaaccaagacgtagaatttcacttggaaatatttcagtatgtatcttcaaaagataaggactcttaaaaaataaaaacaaaaacatactttacaccattatcacatctaagaatcccttaatatcaaatatctagtcattagttcacatttccccaactgtcctgatttttaaaaatagaattcctagactcttgatgtctcatttcttttttttttttgatggagtctcattctgttgcccaggctggagtgcagtggtgctatctcagctcactgcaagctttgcctcctgggttcacaccattcttctgcctcagcctcccaagtagctgggactacaggcgcccaccaccacgcctggataattttttgtatttgtagtagagatggggtttcaccgtgttagccaggatggtctcgatctcctgacctcgtgatctgcccgcctcggccacccaaagtgctgggattacaggcgtgagccaccatgcccagcctgtctcatttcttgttatagcttagtgaacattgtacattgggatcctaaatggtcaaaaccacaaatttttttctcaacagctcaaacccagggaaattaaatacataggttaggtgattaggtagattagatagattaaaaaggaagtcaataatgaattcccttccagattaaagcagtgtaggtcttagatagtaagtggctgatgaaaatgccattctctacacatggcacacacactctgcacaaatgtgcctattggtatctcagtgtacatagtgcagtggcttatagatgccccccagataaaaccttcattgtagcactctccttgcctcctccatgctgggggagaaactccaccctgagcaagaccaggagcagagctccttcctaggtaagcactttttggtctcagtgccataaaatgaagttgtagttagggaagcatccagccttgctcattaagaacttggagttcctggctgggcgaggtggcccatgcctgtaatcctaagcactttgggagggtgaggcaggtggatcacttgagatcaggacttcgaaaccagcctggccacatggtgaaaccccatctctactaaaaatacaaaaatcttagccaggcatggtggctggtgtctgtaatcccagctacttgggaggccgagacaggagaattgcttgaacctgggaggtggaagttgcagtgagctgagatcatgccactgcactccagcctgggcaatagagggagactctgtctcaaaaaaaaacaaaacaaaacaaacaaaaaccaaagaacgtggagttcctttttcattagtatgtcctccatcccaattacacctggcgttataaaatgaatgtacattttctatttgcttgatctaagtcattaatctactagaagaggggaatgagtatctgtttatagggcagtttttatcctccttggagtatttttcattttctgatccaccccaaagccccagataaattcctttgtacctttatgaactaacttgagtatatattgccttccccctttcctgcccatcttccccacccccatccccaggtatgattaacaatgcactaaccatgtactaatgcaatagatcttggctttttattctcttctgtttgtgttgtttggctgtcattttcaatgcagtgctgaagactgtgccctttactgctcgcaccgccaagcgtggctctcggtttttctgcgaacctgttctcactgaggaataccattactaaactattactctttctcacctgatgctcttaaaaggttgctacaggttttttgatgtcttatgtccccctctgtgtgtctgtcagggcccaccaacatgctagcatggaattgccatctccatcatgttatattttgtgttgttctcatgctgcatggttttgcatttcaattattattgctcactcactggccactttcaatacatgtatgtattcacattgctgtaacagtctgggtgtgtttgacagctgaattcatagaattgttcacagaaattttcagaaaaatagagcaaaaatattaagagcacttctttgagaatcagtattggtaccaagtagattgcttataagatttttgagctaatgtccttcaacatatccattaataacaataactgctatacctaacatgtattaagaacttactgtgttcaggttggatgcagtggcacacgcctgtaattccagtactttgagaggctgaggcaaaaggatcacttgagcccaggagtttgagaccagcctgggtaacatagggaagccccatctttacaaaaatcagctgggcatggtggtgcacacttgtagtcccagctacccgggaggctgaggtgggagcattgcttgagcccaggaggtggaggttgcagtgagtggagatcccaccaatgcactccagcctcggcaacagagtgagaccctgtctcaaaaaaacaaaaacaaaaaacaaaacatactgttctaagtaggtttacagatattaacctagcccttttatcctatacccagttaatatgctttgatagcataatcacctgccatatgaaagtgctcaggaatgcgaagtgctctaaagtgcaaaatgacttgcagaaggaactgtgaactatgcacagctgcaaatcaggcctttcttaactctcttatacgtccatagcatgatggaactcgtaatatgagcttaacacagggagcccttttaacctagcttgtatatgtagatataggcaatccatagctttatgtcaccctactttagtaggccacctctattccttctgaatgtcatgcccatgttcaactatcagtaattccatgttggagcaaagctgtgaggcaggacatgaatacaaaggcttaggtcctcccactgtcttatctcattcacgcatcttcaccggtagctctgttccatgtcaaacccaggctatttcttctgtgatcagatcatatcttgacctgcttctttggtcaggatgatggcaccagaaatactaacagcaaatatcattggaaaatgccactgtttttaaattgggggggaaaaaagggtcaaacttttcaaagtaacctcctgggcacagtttttgatgcctaataagaaacgaacttctctccagtgtctagttgattagaaaagagacaagggaaacacatactctaattggacgtagccattgactcctgtgctgagattgacatggaattgggtatgtgtttattttgtggcataactattctatgaattgcacttatgtatgttcttctatctctgatatcaaaggacatagagtgtcattgcctgctctgcagtgtacttacccaccagtgcttattaacaggctagaaaactgtcatctgcttggctgatgtttgctgtcagttttgctgttggactatatctatctttctggagccaatcttcaaagcagcttggaactgggtggtcagagagctgggtgggaagatgcactcatccttcccttatttgatctaacatttcttgtagtaatggcttctcattctcttcctctgttggctaacatgcctgggaatgttgagcactaagttgagttgctttccattttcatcccattttttcttaaccatcattttgtgtttttgtttttttctgtttagccttaaagaagaataatatcactaaatttccaaatgttcactcgagggtaaggatttcttctagcacaccggtggtggaggatacacagagctggcaagcatcactttttacttagcttcctcctctctctgtatgcagatcaatggttttcaatctatggctgagggtaatactggtgagaatctgaccagggagtttttgtacctcacattccaatgatgcagggattgagcctctctgttggactctttctcggcctgcttttaagttctaagtgtgatggcttgggcaagggtatttgctgatgattgtatttgctttgagtgttgggctgtccttcccttacccctgtcttggcctttgagttactcagttaaacccattttgatctgaagcgactgaaagcaggtcctggccaggtaacattacagcctttgaaggattaagatctttagaactaattgctcagaggatgaagaaccacaaagctgcatatgaggcaaaagtgtaattctggcctttcattaccagtgtgggctaggaagcagaggcttgagaggattggggtatgcaaaactattttttccttaaatttaagagtagaggctgggcatagtggctcacacctgtaatctgtaatcccagcactctgggaggccgaggtgggcaaatctgttgagttcaagatcaccctgggcaatgaagcaaaatccccatctctacaaaaaaaaaaaaacaaacaaacaaagttagccaggcatggtggcaaatgcctgtagcccagctacctgggacgctgagatgtgtggatcccttgagcccaggaggtggatgctgcagtgagcagagatcaccactacactcgagcctcagtgacagagactgtcctcccctcacaacccccgcccacccccccagaaaagagtagggcagggtcacacaaattccaatgagtcaaggagccaggaaggtaacaggcctggtaggaactgtgctgaacctagagcacagatcttagctccaacttctttttgctgtgtaggaactggggcccggttttgccagatcttccagtttttcaaaagaagccagaaaccctggtctttatgttaattaccaatttaaacaccaggaaactgtacatgtgcggggggtgggggggcacagtggagcaaacattctgtgggtcaaatgtggtccatcagctgcattttcaacttgttgagtagataaagggatacaaaagattcaatttggtttaattctgttatttgtttgtatttccctttctaaagatagcatgtattctagcagaagtcaacaatactaagttaatgaaagggaagtaaatactaattaaacaggaaaagtataaagcctgctttacttttttcactatgccctgacttcatcaaagggaggctgcatagcctagcctgctggctagctacctgacttactcaagaaagcatgccttcatactgagttcttgtataaaattcctctgctcctcccacttcatcctgacagagcaatgcctatttggactggtatgcagtgattgactcattcatttaacaaggattttcttatgcaggagggcccacacaactacttcttgctgacgtaacataaaaaatattgggtggtagagctcggtagtccccacttctcaggaggctgaggtgggagaatcgcttgagactggttcaagtctggcctggacaacataacaagaccccatttcttaaaaaaaataggtggcagaaaaggatgccagggaatagattattattttggtttagatttaatggttaattgaacatcattttgtttaaaatttacaaaataataaactcagctagcttaatggaatgaaaataatagagcccttatctgcaaactgaaggtctttaggttcttgttaaaactgcgaggaaaagatgggacaggacagtctgctttattaattttgcagtttaaaatttattgcagttactatttattcattcaggcttccagaataaaaacaaaacaaaaaaattaagctacagctgcttctaatttaagaaacatttcaaaataagacttcagctagactctggccagtgacagaaataatctatgtatttttctctcaaagtcctagaatcctaccagtattacatcctgttttgtttgattgtaaatattgaaggcaaatgttttatgtctttgattcaatgctcagtgagtttgaagggcccattagctgacttttctacacaagctgctttgattggctgccagctggcctttgtcctgcttagacacatgctattaaaggttgctattctctcactggcactctcccctttacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgcgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactattctgtaa

SEQ ID NO: 782 - DNA, 605418 bp, Homo sapiens
tagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccgggcccagggaggctgggcgcgcacccggcgccgcggcctgcgggtaatggggcatagctgcccgcgtcggttctgtccaaggctgcggttttgcagggagcgttaggttcctgcaccccctacccgccctttccaaagatgtctgatctcaaagaaggtgagaagtgaatgagcagagtgaagagtttattttcttctttttctgcctgtttgaaaccggaaccctacctagctttgattttaaagtcttgctgaaaaataacagaccaagaacggtgcgccataggtaataattgataatgggaagggtgagataaacttaaggagacttgtttgtgttccaaaataaccactgcgtcgaagaatttcagtgaaatatattgattttagggagcttgggattaacatggagctatagaataatatgtatatgtatatatatttaaaaacttacaaatttttaattttaaaaactgtctcaaaattgatttttttcttaaaatcaagaaattatagcagtgttcgtcaggggaaaattgattttaaggtgtgttaacttatcctatgtaacttgttttaaaccaacttttcccacttcatgaaatccacagcctttaaaatgtgtgtaatgtatttactagtatgctatacactcttttagaaactgatatcaaattttaaagatgcataattactgagaattaggatgaaagtcaaaaatataccttaactcatacagcatgattagaaattcttactgaagttatgattactttaaattactaaagtgttttttctccctttgtgtgtcatttatcaaaataattagatcaaacaacaacaacaacaaaaacccccaaaagatcataaggaagagaaaaaatgatatcttaggcaggatacaaatgagcaccaataatttattctgggttaatttcatagagtaagtggcgaactattccgcctatataatttgagaaaaatgtaggttacagggagatgtcaaatagactctgaactgtgttataataaaatatattaaatatatgtgattaggtataattttctggctctgccattaacacacaatgacttcggacattcacccatccttccaggcattagtttcttcatttataaaataaagtaattggactaggtgattgcaaaggtttatttcagctaaaaatattatatctctcaaattattacttttagaagaagtaaccaagatacacagactttaaaaatttacaactgaagtacgactgaatcctatctccattttctcatttccatgatgaataaatatagcagtcactccttaatgaatgcctgctatgtagtgaattcttagaaaccctttacataggttatcttatttaacacaataccaccataaattgaatagtagtatatcccaatttatagataatgatactgaagaatgaaaagtttaagctccttgcccagagttccagtttataagaactgggtcaaatattttttccaaatgctcttaggacctatactatactgaatgggatgattaaaagctaaaattgcctataaactgaagtaatcttggactactataagagtctataatggggcaaaggtaaattatgtaacactgagtcttcataccattaaatatataagtgctgtatcagtctccatttattatatcttaaaaagttacatatttatgctgtatatttattaattgaatgccagttgtattctcagaaagtgatcatatgagatatatttgtaacacaaatggttttatggtaataaatataactgctagaaaaaatgtgagagggcagaagctagtattaagcaaatgctggtattaagtatgtcagatgtctttctacttgaaggtactcatgcttgagacaaaaatgcttacacccaagggaaaagggtgttcagagtagaattagctgtgactaaactcttttgttcatatcctatgatgaatcataatagtatgtcacatttattgaatatacgttgtatgccaggaattctcttaagccctttattagtataattttatattggatcatgaattaaattgtattatcctgatttgcaaatgaagaaaccgaggcagagagatctatgccctgggaggacccacaaaaaaatactttttatcttagattaaatgtgtgatcgttcattgttctgaaattcttaggctgtgaatgtaacatgaaatcttgaagcactggaaggagacttggagccaaactaaaccaacctctttattttatatttgaggtaaaagagacctagaacagttaagagacgcacttaaggccacatattttagtcacctatacattctcataaactattaggtaagaagtatcctaatgggtaaacttggttattaattgtttgatttattgtcacgcaaacaaatgccacctcatgccgtttcttatattgctgccctacttttatttaaaatttcaaggttgccccaattaggatgcaaaatccttgaagacagtgattgtattatatatttctcttatatagtatctatagggttcagcatagtggttaacctattgaataagttgctttgttgcctgtttgcctttgataagtcattattttatgcaccaggtctgaaatctacacagtggaagcacaatgccatcaccatttttcacttcatgtagagggcaactagacaatttatgatgcttacaaagtgtaatgagcttcttagataattatttaatttggttataaaatgcagtgtgttaccatggagagatttggatgtgtatttccctgattttggggggacaaattgcatagctaagtatcacacacagttcaatttacctccccaccactctgttcttttgatttggaaataacttttttttctgagtgcaaagataatgcaaagtcatgcaggaaattcagacagtaaagaaataatgaaaaaatcaccagaacctccccagtctaaaggttttggtgaacagccagccagagaggtctttcttctcttaactcctgtcgaatcagggtgagagctgaattatttattgaaaccatttacagtaaagttctatttagttttagtattccattactcctgggcagttcagactttatgtaaataaagatatttgttgagcaatgaagataaacatactactaataaactagagtctactccatgtagaatggagtagtacagaaagttgatttcctcacatcgtatgcctaattttttcctttcacaaggtaggtttgggagcacagggagcatcttttgcatgcatggagggttctccaatatgccaggatcttaggccacacatgaagccacagcaccccagctctgttgccctgagtgaggtgtggcagaggaggagaagggtggagctgaggcacaagcggctgtggtaatacaaaggctgtgttttccgattctactgtgacacactatacacttaaaaatgtaccagaccaagtccctccccgagctgctgggcaggtggtcatggggcccttttctggtgcagtcacgcgtaagtctggctttacctcaaagccagggcaagatgctgatagggcatttctcattcatttattcaggattctgaaaacctagaatggaccctcttttatattaaagggaaacactggctgctggaatcattgtccataaatgagtcttgaagtaatactcacaaaattattaagtataaagaaaagttggggcatctctttgagagagacaatagctctttctgtatgcattcggatgtaattacattgaaaatatttgttttgaagattatgttttctggttattttaatttcataaatctatttgttattcaaaacttctttccctaggcatattttctttgtttatactatacatttgagcagagagatttttcatgcttcactttattaggggcttaacatggctttaatccaaccatctgttcgcatcttggcacatcagcatgtctgaggtgctggtaggggccaaataaatttcccacattttaaaggttagggaaagagctacctttatgaatagatttcaaatgattctcagcaagacaatggtatagaagtggagtaaaaatgcatttcattctctgaagcacaaggtcccctgtctgtcttcagttttgctgaaaggcaattagcatttcaactagccaatttggttacatgcaacgaagtacttgggtttataatttgctgctctgtctgaggctgttgagtgctaggtcttatgtaatcctttccaagtagccttctctccagcatagttattgttgctggtcttaaataactaatcaacagagagttttccttgccttcaactgtagggtgccatagggcaaggaaaatgaaataccaagcaaataaggggatgactgtaattataaatagtcattattgaaatgtggcacaggttgaaagacatacaatagcttcaaataaaatgcaactccaaaaagtcattgtgtgcactgttaatggtttctcatgcagtatgcacaataagcatagggcatacatgctgggattaattcagttaacatgactcaaaattaacaaagaaggtgcaattcctttatgccagaaagaattttgttgggaataggtttaaaagagaaaagattctaaagtgttacaacaaatgaataagtgctctgaggcatattgtggaaataaaggttttgtactgtgtgctaattgaaaataagatttttgtcagcttctttagtcgtgaattttgacaattaggtagtattaatatacttcatgtatacactcatatttctctgaaggagccactgtatggtatggtaatccttttgttaggataattaggatgatattttcctgtaatccatgtcatggaccagcaattcagtgtagctcatcttttggtgtaacactgtttttgcatagatgtacttgtgtaattatttggaggtaaaatagtacatttttcattcttcaagtaatgtttaactgaaagaaggcataatagaaagaagtgttttagatatgtcttacaagtgatcagtataattttgagaacatatgtgaaagaattgattttcatttatatttccaatctgcgattataaagcttttgttacggttatagttagaatcattagttttatttaactaatttcaacagtgttgatgagcaggaatgaaatgaagagagcttgttccttctctggcagactagtaagctaaggttggagagtgttctggaaaaagtgggacttgattgggactttgaaaaatggtggaagagagggagtggaaaaaggtagagaggactgggactagcttagattaaaggtgcagaagcatgaataatacaagtgttttgtcccagacacgtattagattaacctggctggaaatgttgaaagaagagaaagagatagctggaagtgcagaggtttgattgttttttaaattgatagataattcacatatgaaaaacaatcacctttcaaagtacacatttccatggcgtttaatatatatatatatttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccactgcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccggcgtttaatatatttaaaaagttgtggcctgggcgtggtggctcactcccgtaatcccaacactttgaaaggccaaggtgggcgggtcacctgaggtcaggagtttgagaccagcctgaccaacatggtgaaaccctgtctatactaaaaatccaaaaaaattagctgggcgtgttggcgggcgcctgtattgccaactacttgggaggctgagtcaagagaatcgtttgaacgcgggagacagaggttgcagtgagctgaaatcccgccactgcactccagcctgggcaacaagagcaaaactccatctcaaaaaaaaagttgtgcaaccatcaccactgtctattccagaacattttcatcacctccaaaagaagctctctacccattagcttttgctctctatcccacctttctccactgccttccaattcctggaaaccagtaatctattttctatctctatagatgtgcctattctgggcattttgtataaatggaatcatacaatatgtggccttttgtgtgtactttcacttagcatgatgttttaaagattcatccatgttgtaccatgtagcaatacttcaatccttttgtaaatgccaaataatattccagagtatggatatgccacctttcatttatgcatttataaatagatgggtgtttgcattggttttactttttgactattataaataatgctgctttaagcatttgtatacaagttttttttgtgctgacataagttttttgttctcgtagtggcccatctaggagtggaattgctaggtcatattgtcaccctgtgcttcattttttgaagaatttccagctgttttctaaagtgtgtttaccattgtatatgcccaccagcaatgtatgagagttttgatttctctctgtctttttatgttaaccatcctattcggtgtgaagtggtatctcattcgggttttgatttgtatttccttaatgactaatgatgttgagaaccttttcatatgcttgttggtcatttgtgtatctcctttggagaaatttctattcaggttttttgcccattttaaaaataggattttgtttttgtttttgttttttattgagtcataagagttcttcgcatactctagatactaatcccttatcagatatatcatttgcaattttttttcattgtgtgggttgtctttttactttcttgatggtgtcctgtgaagcaaaatgtctttaattttgttgaattaatttatttaactttcctttggttgcttatacttttggtgtcacagctaaacaactgttgcctgatacaaggtcacaaaaatttatacccatgctttcatctaagagttttatagtttaagcttttacatttaggtttttattccattttgtgttaatttttaatatgatataagcttccttcatttgcacatagatatccaattatccaggttccatttgctgaataaatcattcttttttcattgaattggctaggcttcactgtcaaaaattaattgactataaatgtatggttttatttctggactcaactctattttgttgatctagttttctgccagtacctcacagtcttgattattttacatattttgttaaatttcttcctaagcattttattgttttattaattatgttgtaaatgcaattattttcttaattttatttttgaattcttcattactaatgtatagaaataacaattgattcttgtatattgattttgtattctgtaatcttgctgaactcttttatttttttatgtatggtgtttttaggattttctatatacaatatcatgtcatctgtagatatagtttaatttatcttttccaaggatacgttttattttttttcttgcctaattgtcctgcctagaacttccagtaaagtgctgaatagaaataatgagagctgagatccttgtcttgtcctgtgatcttagagagaaaacttttggtctttcagcattaagtatgatgtggatacccattatagataccctttgtcagattggagaattatccctttattcctaatttgtataataaaaagatgttgatttttttcaagtgctttttttgtgtcttttgagatgatcatgtgattccctctgctttttttctattaatttggtacattgcattaattggttcttgatggtgaaccaatgtagcattcttggatagatctaatttggttatatagtgtatcatttgttttatatgttactggatttggtttgctagtattttgttaagagtttttgtgtcaatattcataagggatacttgtcttagtttttttcttggttctttttttccataatgtctttgtctggttttagtatcagggtaatactggccttataaaatggtttgggaagtcttgtgttttatatatatatttttaagtttgtgaagggttgatgttaattattccttaaacatttggtagaattcaccagtgaaaccatctggtcctggactttcttcatggtaagttttgcaattactaattcaatctatttaattgttgtgggcatattcagatttttaatttctttttgagtcaattttggatgttcgtatcttcctagggatttgtttacttctaggttatctagtttgttggcatgtaattgttcatggtcatgctttatatactcagttttatttctgtaaagttggtagcaatgaccccttttgaatttctcattttagtaattcaaatcttcttcccttttttcttaatctagccaaagttttgtcagttttgttatcttttttttttttttgacagaatcttggtctgttaccccggcgggagtgggagtgcagtggtgcgatcttgtctcactgcaacctccgcctcctgggttcaagcgattctcctgcctcagcctcctgagtagctgggattacaggcacctgccaccacgcccagctaatttttgtatttttagtaggacagagtttcaccatgttggccagctggtctcaaactcctgacctcaagtgatccacccgcctcggcctcccaaagtattgggattacaggcatgagccaccatgcccagtcccttttattatcttttcaaagaaccaacttttacttttgttgattttctctgttgtatttctattctatattttatttgttcccactcaaatattttttctttgtttccttctgcttgatttgggtttagtttgcctgtttttttctactttcttaaggtggcagtttaggttctttatttgagatctttcctttttttaatatatgcatttgtgcctgtaaattctcttccaagcattgctttaggtgcatcccataagttttggtatgctctgattttattttcattaatctcaaattattttctaatttacatgtgctctcttttttgatcctttggtcatttaggagtgtgctgtttaatttcaacatgtttgtacattttgcacttttttctgttattaatttctaatctcattctcttatggttggagaatatactttgtatgattaaagttctttaaatttattgagacttggtttaggaccttacatattatctcttctggagactgcttcatgtgtacttgataagatatgtattctgctgttgtggggtgaagtgttctatagatgtgtattaggtctagttagtttacagtattttttaactcttcccttttcttgttaatcttttatttagtcgttatattcagtattgaacatggggtactaaagtcactaactataattgttaaattgtctgtttttcccctcaatttggtcagtttttaattcatgtgttttgggattggctttttatgtgcctgtaggtttacaattgttacatctttctgataaattgagccctttatctttataaaatatccttctttgtctgtagcaacattttctgtcctaatgtctattttgtccaatattaatgtcttagtccattttctgaataccagagattgggtagtttataagcaatagaagtttatttgacttacagttttggaggctggaaagtccaagaacttggctctggtatctggcaagggcttttgtgctatgttattccaggatggaaagttagagggcaaacaagcatgtgagacagagaggggaaattagaccaaacttatccttttatcaggaggccactcctgtgatgactaacccacccccctaatagcagtattgttccattcatgagggcaaagccttcataatgtaatcacctcttaaaggtcctacctctcaacaccgttagttacaatggcaattaaatttcagtatgagttttggagaggtcattcagaccatagtaatgaatatagtcacttcagctttcttttggtttctgtttgcatgatatatatatatatatatatatatatatatatattttttttttttttttttttttttttttctcattcttagtttcaacctgtttgtggctttgagtttaaagtgaatcacttataaagagcatatagttaggtcattttttccaattcattctaatgacttctgccttttaattggagtatttaatccagtaatatttaatgtaattactgataaggtaggattgatgtctaccattttgctatttgttttttgagtctatgtcccttttcatcccctgttcctcttttactgccttcttttattttacatagatattttctagtgtatcattttaattttgtggttgtttcttttattatattcttttcattaattttattattggttaccctggggattacatttaatatcctaacctataataatctagctcagattaataacaacttaatttcaatagcgtgcaataattttgctcctatatagtttcatttctgcccctgctttgtgctgttattgtggtacaaattccttttttatacagtatatactctttagcacaaatctattattattgctttatgtagttgtcttttcaatcagagaggctaaaagtagttataataaaagtacatttatgccatcttttatatttatctgtcatgtgaccttttctggcactttacatttttttctgtggattcaagttactctctaatgttctttcatttcaccctgaaagactccttttagtatttctggaaaggaaagttgctaaccacatagtgtctcactttttgtttatccaggaaagtcttaatttcttcttaattttggaatgacaattttgttgcatatagtatccttggtttattgtctttcagcactttgaatacatcactgccttctagcctcctaggctagaggagaaatcagatattaatcaggatatcacttttatgtgataattttcttcttccttcctctttcgtgattctctctttgtcttttgctttggcagtttcgtatatgtctacatgtggatctctttgtgtttattttacttagagtttactgagcttcttagatatgtagattaatgtttttaaatcagatttgggaagccttcagccattatttcttcagccatatttctttaactactttctgttgttagtcttcttctgggagttccactaggtctatgttggtatattttgtggagtcctataggactctgaggctctgttcatctttcttccttattttgtctttttgttcctcagcctgggtaatttcagttactttcatgttcactgattcactcttctggctgcttaaatcagctgttgagcccctctgtgaatttctcaatgtagttattttacttctcaactccagatttctgttttttttttttaaactatctttttgatatcattcatttgatgagaaatcatttttatactttttattgtttatatagacatgatttcccttagttctttgaatatatttaaaacagttgatacaaagtctttgtctagtaagtctaacatctggtatgttctccagggacagtatttatcgattacttttttcctgtgtattgctcatattttcttgtttctttccatgcttggtatttttcttttttaagaaactgtatggctttgaagttcagattctccctcttcctagggtttgttgttgtccctgattttattgttgtttgtttagtgaattttctgaagtctttttaaagtatgtactctttgttatgtgtggccattgcagtctctgcttggttagcttagtggtcagctaatgagtggacagagattttcttaaatcctgggaaacagtaagtctcccagtttttgcttgggagctccatgtgcgtgttgaagaatacctttagcattcagccagaaaattttcaactctgcctaaccttcacttcctctttgcacacagcctcaaaaccagccagaggtgagaatgtagggcttttacaggtttttcatgaacatgtgcacagccttatacttgtgtgtcatcttctaggttctaggaatatgtcagaaatttttaaatttgcaataaatgtctcattgcccagtctttccttttaagcttttagttagcttattgttttcccagctgttatctattacctctggcagctattatgttacataattgtctataaacatttttgacaagtgcctctaaggaaaaggctttcaaatactgggcaaactttgagtcaggtcaaataaagatactgtggtgagtgaagtcttcaagaaaccactagatagatcaaacaatgacaactctgtgaattgggctttgatggctttcctaccccattctgttcccttcagtggctgccaggatgctggttttaactgttattgcaggctgttagtttttaaggtgactttggaggctgggagagttgtgtgggaataggtcaagtttaaatgtaataaagttcactgatttcctggagattcagctgtatttctttaataaatgctccttggaatcctgcaagcccttggttaatttctgaagttctgcaagcattgattctgacagtttttgctagttttctcattatttttatggagcagaggattttaggaggtccttaccctgacatttgcactggtttggattttcagagcaaacattagggcttccccctacctcttgttagatattatggaatcactgtcagtttttgaactacagactgatataaaaatagtcttttgaagactattctgttggtaatgtagagaaggctgattggaatgggcagaagagagcaaattaataaaggcaataacagtggatgtatgttgataagctcttgttttgggtagcagcaaaacaatgttaaatgaaggataaaggaggcatttaaagagggtgtcagaagtacttggtgaccttttgcatgacttctgtatttaagcaggtttgatgtcaataatataaaataaaataaagtaaaataaaataaaaaagttcttctgaagaatatgtcatccatccagtcatccattcattcaccaaatacatgtgaatgaactggtacgaaagcagaaacaaagaccaatggaacaaaatagaaaacagaatagaaataaaactgcacacctacaaccatcttatctttgacaaggccaacaaaaacaagcaatggggaaaagactgtctattcaataaatggtgttggtataaatgtgcacacatgctcacacacgcacacgcacgtgcacacacacatgaattaacaatatctaacaaattatgctttgatggatgtagagaaaaaagagtgaataattttcaaaggaaaaaagttgagaccgtaggatacgtgttttgggactagccttggaaaagggaaggatctcctgtactgtgagagaggagaaaataaagtaattgggggaaattggaattagaatggactggataggaggaaggatacgtcagagaatgtattcatgcccttcctcacctaccaggaagggtggataaaacagacaggtggcatttaaaaggaatttgtccccattcttctgtatattttgttaaactcaggatcaagttatggggcaaatgcatcacagatggcttgaaggtttcccttagatctctccgtgtatagatctactaattaagtaagaaatttaaggccaccagattgtgaggaaacacaataaagtaatgctttccaattcagtttttcccttcagcactgggatgtagcttttcctaagaaaggaagtatggtattggttggcataatgattgagctctccaggatattgctaaaatcagaaatgtggttgaatattatctgattcccactgaatccattccctgatggcttctgtctttttggtggagacttatctaaattacagtcatgcattgcttaatgatgaggatatcttctgagaaatgtgtttttaggtgattttgtcatcatgcaaacatcatagagtgtacttacacaaacctagatggtataatgaaccacacagctgggctatatgtatatcctatggctcctaggctaaaaacctgtacagcatgctactgtattgaatactgtaggtaattataacaccaaggtaagaatttgtgtatctacacatacctaaacctagaaaaggtgtagtaaaaatacaatattataaccttatggaccaccatcatatacctggtccatcactgactgaaacatcattatgcagtctatgactgtatgttggatgaactgccaaaatgagaaataaattattgttttcttctgagacaaattattgaagttttaaaatgttgtttttttaaatgagagaaatttaataaatcacttgattgagaactgggcattaagtaaaaattaagtcccatttaccaaagcataatttgtcagatattgttcattcatgtgtgtgtgtgcacgtgtgcatgtgagcatgtgtgcatgtttataccaacaccatttattgaatagagagtcttttccccattgcttgtttttgttggccttgtcaaagatcagatggttgtaggtatgcagctttatttctattctgttttctattttgttccattggtctttgtttctgcttttgtaccagtaacaagctgttttggttactgtggctttatagtatagtttgacatctggtagtgtgatgcctccagcattgctctttatgcttgggattgctttgtctattgaggctctttttcggttccatgttaatttcagaatagttttttttttttaaattctgtgaagaatgatgttggtagtttgataggaatcgcattgaatctgtaaattgctttggtcagtatggatgtttttatgatattgtttctttcaatccataagaatagaatattttttcatttgtgtcatctgatttctttcagtaatgttttgtagttccccttatagagatctttcacctccttggttagctgtattcttaggtatttcattttctttgtggctattataggtgggattctgttcttgatttaactttcagcctgaactttgtgtatagaaatgctactgatttttgtacattgattttgtatcctgaaagtttactaaaattgtttatcaattctaggagcctttttgtggagtctttaggattttctagatatagaatcatatcgggttgacgccagcttcatagagtgagttagggagaagcccattctcctagatttttggaattagtttcagtgggattgatatcagttccttgtacgtctggtagagttcagctgtgaatccatctggtccaggatatgttttggttgttaggttccttatcactaatttaatttcagaagttgatagtggtctgttcagggtttcaagctcttcctgattcagtcttgggagattttgtgcttgcaggtgtgtatccttttcctctagattttctaatttgagtgcatagagttgttcatactaggctctgaggattttttatatttctctggaatcagttgtaatataacttttgtcatttcagattgtgcttatttggatcttctctttctgtttctttgttaatctagccaggggtttatcaattttatttattttttttcaaagatccaatttttggtttcattaatcttttgaatgaattttgcatcttgattttgttaagttctttaattttagttatctcttttctgtgggtagctttgggattggtttgttctttttttcctagttttttttaggtgcaaagttatattgttgatttgagacctttctaactttttttttacttttaaaaaagacattttattttattttattttgtgttatgttattttattctttgagacagagtctcactctgtcacccaggctggagtgcagtggcatgatcacagctcactgcaacctttgcctcccggattcaagcaattctcatgactcagcctcctcagtagctgggattacaggtgtatgcatcacgcccagctaatttttgtatttttagtagagatggggtttcaccgtattggccaggctggtaaaaagggatattttaatacaaaggaagtagtcaaagaattctgagctcagattgcaggatggcccttttcaaacagaggcagctggccgcttaccttgccttcattttccaggggtttctcctcccatgaatggacagcgaaagcttcatcctagaccaatcctgtctccacgatggctttggggacctgccttgccccagggttttgtctacaggcctggcaactttgaccatgagaggcagactccctctaactggaggctgacaagtggaaactgttcggattattcccagagggcttacatgggggcgggtcatcctggtgaattctcaggcatgatccaaatctgcctcctaggcacagaacaccattctccagggtcgcagtgctgcctggactccaggaagccagtctctgctgctcctggtgtgcccctaggggtggccgaggttagtaaggcctcccctcactggagcagaagacaaagtgatttatcttgatccctgtgaaatggttgcacaaccccaagagcctgagactcatcaaagaatgtccctctttatttcctgttcattacattgccatgcgcaattcagacaagacatcccagcactgcttccagtcctctgcttaagggtgggattctattattattattatactttaagttctagggtacatgtgcacaatgtgcaggtttgttacataggtatacatgtgtcatgttggtttgctgcacccatcaacccgtcatttacattaggtgtttctcctaatgctatccctcccccagccccccgccccacgacaagccccagtgtgtgatgttccccgctgtgtgtccaggtgttctcattgttcagttcccacctatgagtgagaacatgtggtgtttggttttctgttgttgtgatagtttgctgagaatgatggtttccagcttcatccatatccctgcaaaggacatgaactcatccttttttatggctgcatactattccatggtgtatatgtgccacattttcttaatccagtctatcactgatggacatttgggttggttccaagtttttgctattgtgaatagtgccgcaacaaaaatacgtgtgcatgtgtctttatagtagcatgatttataatcctttgggtatatacccactaatgggatcactgggtcaaatggtatttcttgttctagatgcttgaggaatcgccacattgtcttccacaatggttgaattaatttacagtcccactgaccaacagtctgaaagcgttcctatttcttcacatcctctccagcatctgtttcctgacttattaatgattgccattctgactggcatgagattgtatctcattgtggttttgatttgcatttctctgatgaccagtgatgatgagcattttttcatgtgtctgttggctgcatcagtgacttcttttgaaaagtgtctgttcatatccttttgaccactttttgatggggttgtttgttttttttcttgtgaatttgtttaagttctttgtagattctggatattagccatttgtcagatgggtagattgcaaaaattttctctcattctgtaggttgcctattcatgctgatggtagtttcttttgctgtgcagaagctctttagtttaattagatcccatttgtcaattttggcttctgttgccattgcttttggtgttttagtcatgaagcccttgcccatgcctatgtcctgaatggtatgctgaagttttcttctagggtttttatggttttaggtcaaacatttaagtctttaatccatcttgaataatttttgtataaggtacaaggaagggatccatttttcagctttctacatatggctagccagttttcccagccccatttattagataaagaatcctttccccatttcttgtttttgtcaggtttgtcaaagattagatggttgcagatgtgtggtgttatttctgaggcctcttttctgtgccattgatctatgtatctgttttggtaccagtaccatgctgttttggttactgtagccttgtagtatagtttgaagtcaggtagtgtgttgcctccagctttgttgtttttgcttaggattgtcttgacaatgtgggctcttttttggttccatatgaagtttaaagtagttttttccaattctgtgaagaaagtcagtggtagcttgatggggataacattgaatctataaattactttgggcattatggccattttcatgttattgattcttcctatccatgagcatggaaggttcttccattagtttgtgtcctcttttatttcgttgagcagtcctttgtagttctccttgaagagatccttcatatcctttgtaagttggattcctaggtattttattctctttgtagtaactgtgaatgggaattcactcatgatttggctctctgtctattattggtgtatggaatgcttgtgatttttgcacacggattttgtatcctgagactttgctgaagttgcttatcagcttaaggaaattttgggctgggatgatggggttttctaaatatacaatcatgtcatctgcaaacagagacaatttgacttcctcttttcctgattgaataccttgtatttctttatcttgcctgattgccctggccagaacttccaacactatgttgaatagaagtggtgagaggggcatccttgtcttgtgctggttttcaaagggaatgcttccagtttttgcccattcagtatgatattggctgtgggtttgtcataaatagctcttattattttgagatacattccatcaatacctagtttattgagagtttttagcatgaagtgctgttgaattttgttgaaggccttttctgcatctattgagataatcatgtggtttttgtcgttggttctgtttgtgtgatggattacgtttattgatttgtgtatattgaaccagccttgcatcccagggatgaagccgacttgattgtggtggataagatttttgatgtgctgctggattccgtttgccagtattttactgaggatttttgcatcgatgttcatcagggatattggtctaaaattctctttttttgttgtgtctctgccaggctttggtatcaggatgatgctggcctcataaaatgagttagggagaattccctctttttctgttgattggaatagttccagaaggaatggtaccagttcctctttgtacttctggtagaattcggctgtgaatccgtctggtcgtggacttttttggttggtaggctattaattattgccataatttcagagcctgttattggtctattcagagattcaacttcttcctggtgtagtcttgggaggttgtatgtgtccaggaatttatccatttcttctagattttctagtttatttgtgtagaggtgtttatagtattctctgatggtagtttgtatttctgtgggatcggtggtgatatatcattttttattgagtctatttgattcttctctcttttcttctttattagtcttgctagcggtctacctattctgttgatcttttcaaaaaaccagctcctggattcattgatttttttgaagggtgttttgtgtctctgtctccttcagttctgctctgatcttagttatttcttgccttctgctagcttttgaatgtgtttgctcttgcttctctagttcttttaattgtgatgttacggtgccgattttagatcttccctgctttctcttgtgggcatttagtgctataaatttccctctacacactgctttacgtatgtcccagagattctggtatgttgtgtctttgttctcattggtttcaaagaacatctttatttctgccttcattttgttatttacccagtagtcattcaggagcaggttgttcagtttccatgtagttgtgtggttttgagtgagtttcttaatcccaagttctaatttgattgcactgtggtctgagagacagtttgttgtgatttctgttcttttacatttgctgaggagtgctttggttccaattatgtggtcaattttagaataagtgtgatgtggtgctgagaagaatgtatattctgttgatttggggtggagagttctgtagatgtctattaggtccacttggtgcagagctgagttcatgtcctggatatccttgttaaccttctgtctcgttgatctgtctaatgttgacagtggggtgttaaagtctcccattattattgtgtgggagtctaagtctctttgtaggtctctaaggacttgctttatgaatccgggtgctcctgtattgggtgcagatatatttagtatagttagttcttcttgttgaattgatccctttaccattatgtaatggccttctttgtctcttttgatctttctttattggtttaaagtctgttttatcagagactaggattgcaacccctgctttttttttgctttccatttgcttggtagatcttcctccgtccctttattttgagcctatgtgcatctttgcacatgagatgggtctcctgaaaagagcacactgatgagtcttgactctttattcaatttgctagtctgtatcttttaattggggcatttaacccatttacatttaaggttaatattgttatgtgtgaatttgatcctgtcattatgatgttaactagttattttgcccattaattgatgcagtttcttcacagcattgatggcctttacaatttggcatgtgattgcagtggctggtaccgattgttcctttccatgtttagtggttacttcaggagctcttgtaaggcaggcctggtggtgacaaaatctctcagcatttgcttgtctgtaaaacttcctgttggggaagttctcctggataatatcctgaagagtgttttccagcttggttccattctccctgtcactttcaggcacactaatcaaacgtagatttggtcttttcacatagtcccatattttttgaaggctttgctcgttttattttactcttttttctctaaccttgtcttcccgctttctccttcacttagtttggctggatatgagattctgggttgaaaattcatttctttaagaatgttgaatattggctcccactctcttctggcttgtagggtttctgccgagagatccgctgttagtccgatggacttccctttgtgggtaacccaacctttctctctggctgcccttaacattttttccttcatttcatccttggtgaatctgacagttatgtgtgttggggttgctcttctggaggagtatctttgtggtgttctctgtgtttcctgttggggaagttctcctggataatatcctgaagagtgttttccagcttggttccattctccctgtcactttcaggcacaccaatcaaacgtagatttggtcttttcacatagtcccatattttttgaaggctttgttcgttttattttactcttttttctctaaccttgtcttcccactttatttcattaatttgatcttcaatcactgttatcctttcttccccttgatcgaattggctattgaagcttgtgcatgcgtcacgaagttcttgtgccatgtttttcagctccatcaggtcatttaaagtctcctctacactgtttattctagttagccattcgtctaaccttttttcaagtttttttagcttccttgcgataggttagaacatgctcatttagctcggagaagtttgttattaccgaccttctgaagcctacttctgtcaccttgtcaaagtcattctccgtccagctttgttccgttgctggtgaggagctgtgatcctttggaggagaagaggtgctctagtttttagaattttcagcttttctgctctgatttctccccatctttgtggttttatccacctttggtctttgatgttggtgacctacagatggggttttggtgtggatgtcatttttgttgatgtagatgctattcctttctgtttgtgagttttccttctaacagtcaagtccctcatctgcaggtcaattggagtttgctggaggtccactccagaccctgtttgcctgggcatcaccagtgaaatattgttgcctgatccttcctctggaagctttgtcccagaggggcacctgcctgtatgaggtgtctgtcggcccctactgggaggtgtctcccagttaggccacacggggctctggcacccacttaaggaggcagtttgtccattctcagagctcaaatgccgtgctgggtgaaccactgctctcttcagagctgtcagacagggctctaacttcttgataaaggtgttttaaggctattaagtttcttcttaacactgctttggctgtatcccagagattttggtaaattgtgtctctactctcattagtttcaaataatttttacatttctattttaatttcaatgttcacccaggagttatttaggagtcagttgtttaatttccatgtattgtgtaatttggagcggttttgttggtattgcttttcatttttattgcactgtggtccaagagtgtacttggtatatgatttcagttgttttttatttattgaggcttgctttatgaccaagcatgtgttttttttttttttttggaatgtgttctgtatgcagatgagaagatgtatattctgtggtcgttgggtggagtgttctgtagatgtatattaggtctaattgctcaagtgttaagcttaattccagaatttctttgttaattttttgcctcaatgatctgtctaacactgtcagtggaatgttgaaatctcccactatttttgtatggttgtgtaaagtcttttcttaggccaagaagatattgttttataaatctgggtgctctagagttgggtgtgtatatatttaggatagccagagcttcttgtcagattgtaccctttatcattctgtaatacctttcattgtccttcttaacttttattggtttaaagtctgttttatttgatataagaatagtgactcctggtctttttaattttctgttattgataaatcctactccactcttttactttgataaattttttttagagatgggatctcactctgtcacccaggctggagtatagtggtatcatcattgctcactgcagccttgagctcctggattcaagagattatcctgcctcattctcccaagtagctgggactatcagtgtgcaccaccatgcccagctaattaaaaaacaaaacattattgtaagatatggggtctttctgtgttgcccaggcttgtctcaaacttgtcttcaagtgatcctcctgctttagcttcccaagtggctgagatcacaggtgcaaccctccatgcctggcttagtttaaaatgaattcacttcgtatcttaaattttctaatataaataaatgtacaatcataaatacatctgtattaggtattttcattgggtagtgttaaattgaaaacatcactataataaatatatttctaaaacttatctaggatttatttttctaccaaaagtataaataattggaaacaatctttgagtattattgtaaagcaatttgatcattgtgtggcagttttatatagtatttaagtagtaaagtcgggaaactttggaaattgttcatgctttcaggtgactagaatgccctagcttttataagtcagtagcatacctagtagttgagaccttagtataatatatgattaatagactttcctgaagctttttagcttccgagagactttacttcatctcatttttcatttctcagtaatattcatgagtgatatatattaggaattggtcattaattcattctttttttactgaagcactctaacatgagtttgaaaaaaacattgagctggcaatttctgctttcacattttattacagcctcaaaacttgttttataatgatttttagtgatattttaacatctttatgatttcatggcaccatacatttggaaattccattcctactcttctagctaccaaaaacttttccctccctcccctggcacacttctttcagcataggagatgaatgtaaccatagaattagggccccatacttgcattttttcattacttttgttctgttgaggtatcatgatagccacaaaaaacatctaggcctacaactaattaccttgcaaatggtaaatcactgtgggtttgaaattgtatgtaatatgaccattcttattacatagttaatcactaggtgtaagggcttttctattcattaatgttggaaataacagactgtgctgcccataagagactgagttggattatagagagaagagagtaaaatgtgcacgtttcatttgatggtatttttaatacgataggtgctatagatatagtgattttgaaaatgatctttcccatatgactattagtaagatttctttgttaatagaaaatgtatatttagaattttgttaagagtataagagctggactctgatggcttgggtttatatcctggccatttccaaagtgtaatttggcgaatatatttaatccctctgtaactcaggttcctcatttcacaatgggcatactaatagtacctatattatacaatattttagatggttattgggaggattaactgagtttcatgtaaagcagttaaaacagcatgtagtgcttggtaaagttagctgctattagctaatactgtgacacgtaaaattcaaattattaatgattcgggtgcctaaatgaaacttttttttccttagctcctttttcttcttctagaatcccgaagaatgtttaaatttaccttgaagctgctagagctcaagcttcagcccctaagcattttgtttttaatttttacttttcttcttgaagcggagtcccaaattatatgtatgtgctttaggcataaccaacttctctaaaaattaatgacttaaaataaccacttgttttgctcatgaatctgtaatttgggtagagcttggtggggaccacttgtctctgctgtatacagggttcttggggcagcccacctggggctggagtatccttttccaagatgtcttactcaagatggctggcaaattgatgctggctgttagttctccatgtgagccactctgtggggtgactttagcttcctcacagcatcatgactaggtgtcctgagcagtcattgagcaagtggtgcaagagaccagaagtggatgctgccagtttttaaagacttgggactgaaagccagcctgtctttgctagaagtaaatacagtattaagttctactatattttattgttcaagtggccatagaacccacgtttaagaagaggggataaacaacccaccttttaatggagaagtgtcaaaaaattttggttccatattataaaaccaccacactgcatttgctattaattaaaataataacaagcaaggtagctattatggactactttgttgaagtgtacccatttgacagaggatgtggtttctgggttactttaaaaaaggaaaaagccactttgacctcctgatgatgatatattcatacttttgttttacactggaatttcaactgaagcaccaacaaatatatcagatgtcaaaatgagttgtgagaaattatccaaacacaaaatttcaaagaatataacaaaatgagttatataacttttgaattctctcacttacattgagtgtataaaaaattcaagggtaaaatctgagagagaattttctgaggagaattttctgaggagaatttatattgggagaactgtgggggtgcatcccctgtccctctgcccctcatgtgtatctgtgcatcatcgtaagtgtggtgagaagggcttcaacaaaaccccttggagagtatgattttttgcttcaagacaatgacaaaagtcctgatctattactgagggaattaaggaggcctagggttgtaggatggagggcggagtctggataaactgtatcacctcccacagcagggcaaatggaagtgagccccagggctggctgtgaaacctgtggtaaagacgttagcctgaggtcattttaaagggatcctgcccagagggcagcctgtcaggggaaggggagcccaggagtacattgctatgggcatattgtcagaagccatattgtcagaagctgaaattgaaggagatctagattagtcagctgaaagagaagcagtcccgcatgttaggattgaagttgatgggtcctgcagtgagacctctgtagagacttaaaattccactacaatgattcagccaaggacatagagaacgaagccatcttatggcagtccagtcaaataagaacctttctaacctcttctcagttctgatcttattcaaccctcaccttgctctgtccttagtggggatgggaaaccagttggccagccgagtgaggaagaaaagtatcgacaggcaaaaagaaaagatggacaataactctttctccagctgtaagccaccagcttgcagcagtccctagttggggcagaagaagagttaatgttaaatttaagttagagctttgattattatgtggagtgtgccattaaatatttttattataaaagctttccaacatgcacaaaagtagaatagtaaaatgagcccctttttacctccgacttagaattagcaattatcaagattttgccatacttgtttcatgtatgtctacataatatagagtgcagctataaaatgtatggatattttcctacataactacagtgcttttatcctacctagcaaaactaacaataattccatagtattgttcagtaataagtccaccttcaaatttccttgattgtcttgaaaatgtctttttatagttaatttattctaattaaaatataactaagttgtagatagtttatctgacagtagtcttcttggcatctcctacccaccaaccaacagtgatttgttgaagaaatgtggcaatttgtcccatagaatgtccatgttctgaatttgtttgttctcttttttggattacttcacatgtttctttagcccccatttttcctgtaaactggaagttagctctaaagccccaattagatttaggttctgctttttgggcaagaatgctacatcggtatggtgctgtgaatttcatattgcatcacatcaggaggcacaccgtgtctggctctatcactttagtgacattgggattcagcagtgggttcaggtggtgacagctcagtcctttcattgttaagtttcccattatctttgtatctaattgtttcatccatgcatgctggcttccttgattattttactaggagttacaaataggtgcttttctaactctgtcattcttacctcattagctggaatttttctgtaaggaaaaactttttccttaacaacttggctatttggttacctggaaaaggagtttacctaggatagacaggataaatgtttaattctttccctttaaatattaatttcagagtaagtagtttgtgccctagttaccttcagtggtggccattgaactgactttctttccatctttcttttcatccctatgaacatatggatttatatattccacgtgtttcaaacaatcacattcattatccctttagatactcaaaaattttaatctttagccaatgggaacgctttcatgtttctcttgtgacgtgaccccattactcttacctggtttccttgctcaagatgttcaggtttattttgcatatttctttccccagataccagtcattcctctaaaaagtgctgcttccttgtagtggggaatgatggttagaggcaaaagtctgggcccttatgatccttattgttattgagttgtcattacttggaagtctttttagtggacagagccaggaaatatgtattttttacaaagaaaaaagtcatgacgtgatactgatatttccagtttaaatttaaccttacagaaactttacatgatttctttgatgattttattgtcatttctcttttctgtgtcttttttttttttttttttttaaatggagtcttgccctgtcatccaggctggagtgcagtggtgcaatcttcgctcactgcaacctctgcctcccaggttcaagctattcctcctgcttcagcttcctgagaagctgatactacaggtgcgcgccaccatgcccagctaattttttgtatttttagtagagatgaggtttcaccatgttggccaggctggacttaaaactcctgacctcaagtgatcctcccgcctcagccttccaaagtgctgggattacaggcatgagccactgtgcccagcgtgttttctcttaagtaattattatttgctctatcctacaaaatgtatagtttcaaaatatatatctacagtatataaaacgtggtttcaaaatgtatattctatagcataaacatttaatttcacataattatactgatattaccactgagaatatttaatgaaatataagctttctttacagctgtatttgtccttagaatttattctactaggtatagacagtgaaaatactgtattctatagccactagaaaaatttatgtctgtgctattatcactactttatattcagttgctttatttcagttatttgccagtatatatgcatttacttataaaagaaacgttggtgacttaaaacctagtagaaatgattatctatagagggaggaaaagaatgggtaaatggaagtgagcattctctgaatatactttcttatataggtttaactttggattcatataaatgtgttatatatttagaaagtaaaaatgagattaaaaaatcttcacctggagatgccaaatagtctcatggagataatgagtttggaatttaggggaagttaggaaatttttggaagttaggctggagatgtaaatttgggagacggtattttaaattacaggtgagtgaatgagaccagagtgagtctgaatgtggatgaagcagtctgagcctgagaagtgatacgtcccatgacgtagaggtcagaaagaaggcaagggttcagcaaaggaggcagaggggcttctagtgaggtgagaaggaaaaccagaggagtgtggtgtcaggaagccacaggaaaacgtgactcaagaaggaagaactgaccatgtgccctcccactcactttttgtattgctatcctttcgtatgttctaaaccacaaatgaatatctaaagagtcataagaagtagctgaagttagggaagcgggggatatttagagtgggagggtacaactctgataatgggaaagtgagtccaagtgagaagttgaagtaaaccaattcattgaaaactttaactcggagcctaactgcctccttataacctcagaattctcagctgattttgcaacttagatggaaatcaggaattaaaagagcatcaaactaaaattttcagtcagaataataagaagctaaaagtattgtctttcaagaaacacaaagagaaaaataaagatatcttctatttttttaaaggcaattgattagcctaaattttttgattgaaggaaaagacaattatcatgatagaaagtgagggtggagtgggtggtataacttcaaagtgttctgcacgctggacacattgatcaaaggcaaaataataaaagagggaagtctgaggagtcattacattattacaaaaagactccccgtatttcagtttatgacaccagagttcctaagttgaagtcaagagatgaaagataccatagttgatgcactcaatgaattctgttaatggcttccttttcacttgtgaattttcttcaaaggtaagttttaggtacaaaggatttcacagaaggatgtgaaatacatgcatgtggagggaaactggcttctctcctcaagcaatgtattatggctgagaaagaaagtgtggaatggaagaaaagtggggaatggtaaaaatacaatagatgatctgttttttgtttcaatgtctatatgcttgtgttgattaagtgatatttttgccttttttattttataaaaacatttgacatgtatgaaacatgttaaggagttccctgtttgcttatgggtggagaagacattaatctaattctaactataaggttgtaattaagccctgggtgtttatacccacaattcaagtgctagattctgggtgttaaatgatcttagttttaaggttttggttcagagttctaatttctggaattttgcttttcaaaaacagcatcagaaatgaccaaaagtaaaatatattcaatgtagaaactatggaaaacatagaaaagcacaaagaaacaccaaaattactgaaaaactctgtacctaaaggttgaccactgttcttccagtgcttttctatggatatactcacttatatacataaatatatttgtacatttttttctattttaatgtaaaatattccattttagattaacatgctgcatcatgaaactcatttaaaatataccttgatattttatgatatgacttcccttattattttaaataattataagaattaaaatgacacgttttgttgtatttcatttgaggaattcatgtgtattcaaacagcaggatcagaaacagagatattttgttatctattgctatgtaagaagccatgtccaaacttagtggcttaaattaatttacgatgatttctcacaggtctagggtttgaaggacttagctgggctcttcttccttggggtgcatcatagttgcagctcgataacggctgaggctgatgtcatcttactgcttaatcattcatgtatctgatgtctgagttgtgatgtcatatctggacatgacatgtatggatggctggaggctaactagatatgtctctttccatatagccattccatgtggctagcttaggcttcctgaaagcatggcagtcttaggtagtcagatcccttatactgtggtgccttcctctggggcaggcattccaagaggactgggcagaaacttcaaaacaacttaatgacgtagcttcagaagaccaagaatgtcacatttctactccattcttttggtttagcaagtcaccaaagcccagattcaaggggagaggacttagactccattctcaaagtgaggagcactaaagaatttgcagctacctgtaatctattaaaagtggccccatccaatttgaaagtataataatacactgttattttaatgttctgtaacaacagacatatctgtcatgttatatattcatttaaatactattactggaaaaatggcacttgtgtgtttttttaaataaaaatgctgtaatagtatttttgtattgtatttatcctacttgttacccttgaacacttcccagtgtctgtagttttcataatttttttaatttttaatttttgtggttacatagtaggtgtataatttatgggttacatgagattttttgattcaggcttgtaatgcataataatcacatcagggtaaatggggtatcatcacctcaagcatttatcctttgtcataaaatatttttaatgaggctgagcatgatggctcatgcctgtaatcccagcactttgggaggccaaggtgggtggatcacttgaggccaggagttcgagactagcctgagcaacgtggtgaaatcccgtccttactaaaaatacaaaaaattagtcaggcctggttacaagccatacttgtaatcccagctacttgggaggctgaggcatgagaactgcttgaacctgggaggcagaggttgcagtgagctgagatcacaccactgcactccagcctgggcaacacagcaagactctgtctcaaaaaaaatatatatatatattcatatttttctgatatatcacttctgaaattatgtaaatattatctactggttagataaaatagttactataataatgacaaaataattgttcactttaaattgtaggggggttaagcaaaccagtatacattataaacagctaaaataactagagatttgctaaaggaaaggcataattgctaatggctcaatgcttaactgaccactagggaattgtaaatgattgaaaaagtcaactaatccgggacacttaaagtgaattattgtgttagtagctaaaaatactttgaacctgaagtcccacttgttgaaacattcttttagtagctatggttttgttcatgtaaattgggtgaattaataagaattaataagaataacacaagttattgaatggttaacataacttaggcattgcgctaagtatattacatacattatttcagtgaatcctcacaactactctttgaggtgggtgatttaatttcacattttcagatgagaaaacaggtttagagacacaactgagatttagagatgctaagccacttgccaagctaactcagataataaggagtgattcaggatgtaacttaggtgatgtaaactcaaaacaaatgtttggactatggaaaacagtgtggagattccttaaaagtagatctgccatttgatccagcagtcccactcctgggtatcaacccagaggaaaagaagtcattatatgaaaaagatacttgcacatgcgtgtttatagcagcacaattcgcaattgcaaaaatatggaactagcccaaatgcccatcaatcaatgagtggataaagaaaatgtggtatatatgttccatggaggactcagccataaaaaggaatgaaataatggcatttgcagcaacctggatggaattggagaccattattctaagagaagtaactcaggaatggaaaaccaaacattgtatgttctcattcataagtgggagctaagctatgaggacgaaaaggcataagaatgatacaatggattttggaaagggtggtaggagggtgagggataaaagactacacgttgggtttaattagatcccatttgtctattttggcttttgttgccatttgttgcttttggtgttttagacatgaagtctttgcccatgcctgtgtcctgaatggtattgtctaggttttcttctaggaaggaacttctgcacagcaaaagaaactaccagagtgaacaggcaacctatggaatgggagaaaatttttgcaatctacccatctgacaaagggctaatatccagaatctacaaataacttaaacaaattcacaaggaaaaaacaaacaaccccatcaaaaagtgggcgaaggatatgaacaggcactcctcaaaagaagacatttatgcagccaacagacacatgaaaaaatgctcatcatcactggtcatcagagaaatgcaaatcaaaaccagaatgagataccatctcatgccagttagaatggcgatcattaaaaagtcaggaaacaacaggtactggagagggtgtggagaaataggaatggttttacaagtttgatgggagtgtaaattagctcaaccattgtggaacacagtgtggtgattcctcaaggacctagaactagaaataccatttgacccagcaatcctgttacttggtttatacccaaaggattataaaaaatcatgctactataaagacacatgcacatgtatgtttattgcggcactgttcacaatagcaaagacttggaaccaacccaaatgtccatcaatgatagactggattaagaaaatgtggcacatatacgccatggaatattatgcagccataaaaaaggatgagttcatgtgctttgcagggacatggatgaaactggaagccatcattctgaacaaactatcacaaggacggaaaaccaaacaccacatgttctcactcataggtgggaatcgaacaatgagaacacatggacacagggcggggaacatcacacatcagggcctgccgtggggtgggggctgggggagggatagcactgggagaaatacctaatataaacgacgagttgatgggtgcagcagaccaacatggcacatgtatacctatgtaacaaacctgcgcattgtgcacatgtaccctagaacttaaagtataataataattttttaaaaagagtacacattgggtacagtgtacgctgcttgggtgaggggtgtatcaaaatcttagaaatcccaccaaaagaacttactcatgtaaccaaataccacctgttctcccgaaacccattgaaataaaaaaaatatgtagtattcaaagaaaaaaaatcttttatcattaactatgatcttggtaggagtttttttttggtacaagctttttatcaaattagcaaattctcttgtattccaagcatgctaagaattttatgttttttacataactttcttgatatgtaattaaattaaaataaacttcttatgtttaaattgtacaatttgatccactaccacagatgtatacatctgcaaaaacattactacaataaaaatagtgaacatttttataatccacccctcaagcaaacacaagtgtttgtaagtctgtgtaatacgatttcttcttgaaataaaaaagtatagattggtaatttggaatatgattaggtttagggtagaagaggatgcaaaggtaaataaaatatgacacactttgttatggtgtggctgtgtccccatccaaatctcatcttgacctgtagatctcgtaatccccacatgtcatgggaggtaccaggtgagaggtaattgaatcatgggggcagttacctccatgctgttctcatgatagtgagtgagttcttgtgagttgtgatagttttataaggggttcttcccccttcgctcagcacttctctctcctgggacatgtttgctgcttcttctgccataattgtaagtttcctgaggcctccccagccattcagaaccatgtgtcaattaaacatctttcctttataaattactcagtctctggcagttctttttttttttttttttttttaatcattcttgggtgtttctcacagagggggatttggcagggtcataggacaatagtggagggaaggtcagcagataaacaagtgaacaaaggtctctggttttcctaggcagaggaccctgcggccttccacagcgtttgtgtccctgggtacttgagattagggagtggtgatgactcttaatgagcatgctgccttcaagcatcagtttaacaaagcacatcttgcactgcccttaatccatttaactctgagtggacacagcacatgtttcagagagcacagggttgggggtaaggtcacagatcaacaggatcccaaggcagaagaatttttcttagtacagaagaaaatgaaaagtctcccatgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcagctggccgggcggggggctgacccccccacctccctcccggacggggcggctggccgggtggggggctgacccccccacctccctcccggactgggcggctggccgggcggggggctgacccccccacctccttcccggacggggcggctggccgggcagaggggctcctcacttcccagtaggggcggccgggcagaggcgcccctcacctcccagacggggcggctggccgggcggggggctgacccccccacctccctcccggacggggcggctggccgggtggggggctgacccccccacctccctcccggactgggcggctggccgggcggggggctgacccccccacctccttcccggacggggcggctggccgggcagaggggctcctcacttcccagtaggggcggccgggcagaggcgcccctcacctcctggacggggcggctggccgggcggggggctgaccccccaacctccctcccagatggggcggctggccgggcggggggctgacccccccacctccctcccggacggggcggctggccgggcggggaactgacccccccacctccctcccggacggggcggctggccaggcagaggggctcctcacttcccagtaggggcggccgggcagaggcgcccctcacctcccggacggggtggctggccgggcgggaggctgacccccccacctccctcccggacggggcagctggccgggtgggcggctgacgcccccacctccctcccggacggggcggctggcctggcggggggctgaccccccccacctccctcccggatggggtggctgccgggcggagacgctcctcacttcccagacggggtggctgccgggcggagaggctcctcacttttcagacggggcggctgccgggcggagaggctcctcacttctcatacggggtggctgccgggcggagggtctcctcacttctcagacggggcggccgggcagagacgctcctcaactcccagatggggtggcggccgggcagaggcgctcctcacatcccagacagggcggcggggcagaggcgctccccacatcccagacgatgggcggccgggcagagacgctcctcacttcctagatgtgatggcggccgggaagaggcgctcctcacttcccagataggatggccgccgggcagagacgctcctcactttccagactgggcaaccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatccccgcacctcgggaggcagaggctggcggatcactcgtggttaggagctggagaccagcccggccaacacagcgaaaccccgtctccaccaaaaaaatacgaaaaccagtcaggcgtggcggcgcgcgcctgcaattgcaggcactccgcaggctgaggcaggagaatcaggcagggcggttgcagtgagccgagatggcagcagtacagtccagcttccgctcggcatcagagggtgaccgtggaaagagagggagagggagaccatggggagagggcgagggcgagggagagggcgagggagagggagagcgagagggagagggagagtgagagctctggcagttctttatagcaatatgagaacagactaaacacacttcttaaaacaaaaacaaaaagagtggtgggtggtctttttagttataagacaaagaataatattacaggtgatttataagagagatatgatcaactcatcttcactatgtggacacaggacagaggcagagggtagttgggaggttacacttagttttggtttgatacatgtttgagggactggtaggacatttgtttggagatgtgtagaagtcagttgaaagtgtgagcaggattggggatttatttctttaacaagaattattgccactataatcaaaagtttgccagaaacttcgaggtagctcagtggaagtgttttgatagctgacaatatgagtgttgttctgcaggatgtaaatatcaatggggaaagttgttctgtggccattatagattttggaaatattgaataaaagttgtattcttttaggcctacttagggtttgttatagactttagtaagtattttgaatatttaagaaggttatttagtatctgcacaaatgtatttcctaaatgtatttctaacagaattctttcatctgatcaaaatgtgggcataacattgcatagaccacactggggaatattggttggaacttaaatgaaaggataagagttgcactgggagacttttacagggaccaggcaaagctgagattgctcagaggacagggttaaatctgatattgaagggaaggagggagttgaagtggaagcttgaagaggaaaccaggctgagaatgggaagttgtttgtaggtaagaagagtgcattcgtgggatgaggagcaaaggagagagagaaagagggagagagaagagaagagaggaagaagagaagaggaagataaattaagaggtaaaatcttaaacatgaaagaatgaggtcagaagcatagatggtgggttattcttagagaagagtatgcatgttccatttttggagacagtctatggagatagagatggataattttgagggaagggaaataaaatcttttaaatgtttgaactattacaaaagtttaagggtggacagttaatattgatggggaatctgatgcaataatgaaagcaaataagaataaacattcttattttaaatgtatgaagatatactattcattttcagtaactattcacgcggtagtgtggagggcgtagttgggaggcaagaatagatttaaaaaggatttactttttcttaggaaaaaactcactggagatggaatcctatttaaatgccttgattttcgtcatgtttactgcggtatacccacgccttcaattatgcctggcagatagtagagactcagtgagtactttttgaatgccattgaatgatgaatgaatgttagacacagccacagcacatcaatagtgcccacatgccacacatggctttcctttaagctctttcaaacttgtgtccatgaacgaaaagactaagctcttgaaaagacttggcgctaagccctgtagccagggagagctgcttagggaccctgtgggctaaagatagcactaaagaaatggcataggcagtggagcgtttctcctctgaagaaagcacatacagagtacgtgctgacccgtgccaggagttggggctagcgaggcacatgggacacagcctgaagtagcaggcctggacagatggaggaagactggcttaagacagggcatcaggtaccggagctcagtggcagctgaagtactgtagtctgggagacaccagacctcctttaggaatgcattagccactggaattcttagagcatacaagtaggggagctccaagaggtaaaaatggatttcctgccagtgtgatgcatggcgtcttgagtaggatttaatttaatttggaaaataacggagtgctgacacatttgcaccatgggtgttgtggactagttcatacttgttacatgctagggataccaaggaattaataatcttcgttacatcacagctataagacaattttaatcaaatctatcaatctaaccctattatccctccaatcccagcagagtactgaaacacagtttgggctgcatttaaaacaaaaaaacccaccaaatcctttaagaatgagaaaagaagagaaacatttaattttggaatatgtgtaggtagtagctcatggccataaaaaacccccaaagagtagaggcttaaggtaagaaaagaaattagatggttagagtaaatgcattgagaaaaacacaggtgtacttacaaagtatgttcgtgaaagccaaaaaagtaaagccaatatagtattaggcattcacttctctgcaaagatgaatttaaatcaaacctaatgaataccttatttaaaattttaaataaaaaattttacaaaatgttttatacagctctcacccatctaaatgatcagttattgataaactcttaggcattccctaaactagaaaattttcatcccttgacatggaatttttaaatgttctgatagctgttattaacatttttatcactaaatacatcagtctgaaatgagtttaccctggagttagtgttacttctagagggtacttaacaatcttcaatggatttagcaaagagtattttcacatttggtttttacctgattgataaatgcttttgtaatcttatcaagcattatagaaagtcattaaaaattgatcttaggctttatcatctttttttttatttataaacttctgtgtaactaagaagccagagaagcccaatctcagagatttttccttagagatataagcatatcgacaaaacatcgtagcataccgagatgacatgaaatctcacaagttcaatgtgtatgaggcggatggagaaataatactgtaaagtcattggcttcaaacttcctgggatggaaatgtttgtaatccaggcttaggttttacaagtttcaaattgatggaggattgtagaagttgggggaataatagagcatgttcaggtattttggttgcaaattaaggctcttattttaatataattttgtacagtccttgaggccctgtggaaaattgttaattgaagggattgaatgtctaaaaaatattaaatatcttgttttagtttggtaaatggctcctggtagtgacaatagataatatgacacgcaaataccttgcaaatgggaaagaggtagtacttagttggaccataagtgatcttccggagctctgcctaattcatttgagcatcacatatatattttttattattatactttaagttctagggtacatgtgcacaacgtgtaggtttgttacctaggtatacatatgccatgttggtttgctgcacccattaactcgtcatttacattaggtatttctcctaatgctatccctcccccttccccccacctcacaacaggccttggggtgtgatattccccaccctgtgtccagttgttctcattgttcagttcctacctatgagtgagaacatgcagtgtttggttttctgtccttgtgatagtttgctgggaatgatggtttccagcttcatccgtgtccctgcaaaggacatgaactcatcattttttatggctgcatactattccatggtgtatatgtgccacattgtcttaatccagtctatcattgatggacatttgggttggttccaagtttttgctattgtgaatagtgcagcaataaacgtacatgtgcatgtgtctttatagtggcacgatttataatcctttgggtatatacccagtaatgggatggctgggtcaaatggtagttctagttctagatccttgaggaattgccacatatttagccagaataataaaatgtttatttttcttcatatcattggtaaattcacacaattccattttgtgtcaaaagtaataaatgaaagtgagaaccagaaaacagcacattgtgaacaaaattaaataaagacctacttctttttaaaaacaaaaattaaaaaaaagatgcattaaaaaaacattcaaaatatcctttcacttagaagcaagggaaaacccggccgagcgcagtggctcacgcctgtaattccagcactttgggaggccgaggcgggtggatcacccgaggtcgggagttcaagaccagcctgaccaacatggagtaatttcgtctctactaaaaaatacaataattagccgggcgtggtggtgcatgcctgtaatcccagctactcaggaatctgaggcaggagaatcacttgaacctggcggtggaggttgcagtgagccaagatcacgccgttgcactccagcctgggcaacaagagtgaaactccatctcaaaaaaaaaaaagcagcaagggaaaacgaattcttgtaaataagccttgtgttaaataggaactcatatctgtggcaataggctttttagaatttcataatataacagactttttagaatatcataccactaggaactccacttaccaaacctgagatgcagccaaaactatacatgaagcaaaaccgtatcttttaaataataaaaagtaacttggttttcaatttatgaatcttaaaagaataccgtactaaaccaatcaggatagagaattgataaagattaaaaatgaaattgatgaattagaaaacagaaaaacattggacttaatcccagatcaaaataaccaaataaagtcagtagtcttataacttcattttacagaagaggaagtagactcagacgttaacaatagactcaaacattaacagcctgctcatagttgccctgctggtaagtatcagagtactctaagggcatagatgctaggctctgctgcatttttttcagtgtgaagattggaattatccaactggccaattagtctaaattctgggtaacagtttatagctttaatggctagaaagtggtttgcaagtgatactgctggaggctataattgcttgaggaagccaaggaaatatagtaaaaaccagcagtcatttggggattgctggaggcttggacaataagggtatacaggcatcactacagcctggaacattatgatcaagagccttattaacagaagaaataatgaacgtagacacatgatttcagagaatatttgaagaggaaaatctgaaattgttaattagccttttggcaacacatctccataaatgtatgctgtaatgatcctgtattccattaattcttttagactcccgtatgtgtatcctattcatcatccaattagattccattcccaaattctgcagatttacaatacaacatcctgacaatgtttcgatgcctggtacagtttttaatatgtcggtagatagatggaaggaagtaagtttgtttgatttaacggaaaacagtaagaaattttcgaaaggggagaggggtgctatacataatgacttccttccaaagtagttggtatggaaaagagggcaagagtaactttgcagtggagcaccctgacaaataccacctcggccaggtaaccaagctcgacaccaatagtgataagtcatgttgatagtatgtaccttttgtataagtgatgagaaagtctttttgcctttttggtcttccccaaaacccataaccccagtctaatcatgagaaagttatcagacaaatcccagctgagggacatgctacagaatacctgaccacattcctcaaaagcgccaaagtcatcaaaaataagaaaactctgaggaaatgtcacagccaaaaggagcccaaggaaacatgacaacccaatgtaatgtggtgtcctggatgtgatcctggaacagaaaaagaaaattagctaaaaacgaagaaaactggaataaagtgttgactttaattagtcaaattgtattatgctttgtatttctgttgtgttttagaaatgattaatagacatggtggtggctcagcagaagctgggtggttaaaagatttgtggtgtttaagcctgaagaaagactgggcacatgcaaagtggtgtggcagtggtttccatttcaaaacactttcagggcctcttgatctaacttttggtttctatcatttctttttcctttttattttctaaacctggaggaaccacaaattattacagatgaaatacaaacttttttttctaaccatgaaaagtactgttctccttctctgagatcatacatgtagctgggagggtaggcatctgccaagttcccagacctctacctgtgcttcccatgccagttgcagtgtgtagaggtggcggatactgtggttcaaattttgggggtcatccagaacatcagaagccccaacattttgttctttcacatacagtgttgtaattcatttctcttctgaccttgaagtccatgatgagttttcattgttcttttaaactttcctaagttctcaatgtttccatctacttcaaacattccttcactctaatgttgctactgtggagggtaggcaggagcttgtggatgtatgggtggtgctcatataagacagtccaggatgcccaatgctgtttcctttggtctcttgaccatgtggagattgaaggtctacagcctagaaactggcacttcatggtgcacagagatggattccctcccctgggcctcatgactacctcagtgctgtagcttttcattttgcttccctttagcaattgaggaaactcaaggccatgtgaagggaagtgacttgtctaaacttctacagctgggaagatggcagagactagattggagcccaaagctgagtggaatcaatgcttgcctcctgctttggaggtgacttggggcccaacaccccaggaggcacttgcagtgtccagctaaaggtttcatggcatctgtgttaggatgcccatggaggtactgccaggaattcttcccattgtcctatgaaatcaaagtcctgggacactgcatggaggcattccacaaggtggtgagcgtgcatgtgtgtgtacgtgcctgcacacacgtgtgtgcaggcacgtacacacacatgcacgctcaccaccttgtgaactggttttccgcctctgaatgacatggagataagaaatttcttactttcctctttgaccctagtctgaggagacattaggagggtataggagagcaaattctctgtctaactggcagctactgcttagctccaggcaagggatgccatggagaaatgtggacccagatttgccaattctggtaatttttcaaaataatctagacatccatttttttaaaatgtgaaatctacaaattttaaatcttggcaaaaatgatcttttagtattgttttgtaatcacagtttggactaaaaaacacatatctctaggcatctgggtttgtaacattaaattccctcttttgctttctttcttactggcagtgagtgcaaataattcatttagaaagcataagcacctagattcttcaataaaaacagactgtcttcaatgaagagaaagaaactcacagaaagtatccaaagaaacaatttttaaaaattagataatactactgaatttcaggagaaaaaaaaaattttgtttgactagagctaattaaagttgttttcagtgagatcttaatttcaagaaaactgcttttcatgactttttaagatctatgtaggattacaaaattacgtttgtttgagaagagttacaggggtcaaaaatctatccttagatccttaagaccgcttcataatatgtgaaattgttgctgttgattttttttttagacagacgggtgccatctaatggtggtttaagaaatcttagttaaacatgtgatccttattttttaaaggacctaaaagacaagagttatcttactacttgacagagacactgtcacatactcagatttataacctatatgagcaaactttgacttattttattgcttctaaattggcctcaaaggatttagattagtgagattttcattttgtgctttgcaaatgtgggagagagaaagcacaattgaaacccataatcttctagagctccacagagctctggaattaaagcttctctacactgttcttcctgtttccatggtgggcatatgtagtccaaatataaacagctcgaatggcttttgtgatctgttttttgatgactcatgcaaacgggagtacatgagctcatggaaaatgtcaagcttaaatattctagaaagaagatagaaatcagaagttcagttacatgagttaaaagactttatgtaaccccaacactctgggaggccgaggcaggcggatcatgaggtcaagagattgagaccatcctggccaacatggtgaaacctcgtctctaataaaaatagaaaaattagctgggcgtggtggcacgtgcctgtagtcccagctactcaggaggctgaggcaggagaatcgcttgaacccgggaggtggaggttgcagtgagccaagatcgcgccactgcactccagcctggtgatagagcgagactacgtcttaaaaaaaaaaaaaaaagataaaaaaatagaaaaaactttgtgtattagatcagatatttacttgccctgtttctgttatgtaaaatgttacttttcctggaagtatttgtctgtactgcattattgttcatggaaatggccattgtagaatcagtcttagtatgtaccatggcaatttgtgatatcatggttacttttctggaaaaaattattgtgtgtaggtacattttttgaaagtttacaagcgtaactctcacacaaatataaaatgaacatgtcaagattttattcaacccattagttagtgaggaaactaatagagtgttaatactggtgcaaaaagcatttttggaacaaaatatttacaagaaaattaataaagaaatgataaggtaaggtttctgggtgagatgtaaaactggttaacatcctaccgggaaataaagctgtaacttatggattatatgtttcactgtacaaaaattacttgcacttttcagccaagtaaaaggatgatgaaaaaaaaagaaaaagaaagtacttgcacttttataggacaaatttttcccaatttacatgtgacttcactaagtctgagatcttttatcaatggtaaacaattgttgatttaactaagtgtgttttattgagtggtctgtgccttgtatgatcattaaaagcatagtccacacactactttttggcttgtattcaagcttgggatacctttttcttaaaaaataatcagacgttagcctcatgtctgtgcctatgccattgtcagagtaaaataactgtgtttgtctgaatctgacaaaactaaataaggcaagggaggatgaagagagtctcttgctttctttttctataccatgcttttcctaccttctcattactctaagatggtgggttaatctatttctttacttgttttttcattaaataagcatgtcttgagggtcattgtataccagggactgtactaggtggtggacaggtaaagctattcaagatgggcaagctcaatgtcctgcaggtgtttttgttctaaggagagaaacacaataaatgcaaatagcgacaactacaaagaaggaaacaaaagggcattgtttaaaagaggaatattaggcttccaggtagacattcgtgttgggaatttatttattgtctcagctacacaccataattattgtagaactcatcaataaaatggcagtttccattgactttcactacacctatccattcattctccagggaagggtagacacaattatggtaacttgcactttcctagaccacatgttgtgaaacgtacatcaatcaaaagtggttgccctctacacctagggggcagtagatatcctggtattcccctttatatcatcctgggatttcctttgatgctttgctgtgtttgactcttgattgctgatcctatattttcttctttcttagtttacttggtttattcccttgtttagatggagaactccctccagtaacatcttgagaaagggtatgtagagacaaaagttttaggtcttttatattaggaattatcatgatattatccttccacttaactaatagtttcattgggtatagaattttaactattaccttcagatagttacctttaatatagcactttacagaaaagggttttcaaacaattagagaaacctgcaaggacaaaaggaaggcgagaggaaacagttgcaactcagttttggagccagaaggcaaatggatgagtagtgattctcttagcagatccaagaaagcttagcagtaagctaggaggctgagaaatagccaaatttatacagaatagccactaaaggcacaggaaataatagtatcaggtacctttaaaactttggtggtgagtgagcaactaggtggggagaaaactgctgcaggagatccttaaaatcatcatcccttccatcctgtgctgctgctgaccccctgcttacccctccaaatctggtgttcattctccaggaaaggtaaaacaggatctcttgaatgatgatgtgagccgtgtttgtgggttaggatccctaaataaaacaggggattaagtgaccatatgatgatcgaattcagagactccagttttttacccccttctactaggtcccagatgtcctggtaattatatctgtaccctttaggtgggagaatggaagattcttctttggggaaactgatcaatgtaagagtaaagttttttctgtagatactaaaattgggactttctaataagtggttcactcgttcactgaaagttgacaagccacatccttctgcacatgctcagaactttcaagtattattttggtcacttatccttgatcatatgaagatatgaagatccatatattcagagcatcccagtcatcagtttagtctcataattttaagtatatatagatgatgaagaattaccagatatagaagacagattccagaataaataacaaattatttttgttaatttagaggtaacaaagaatacaaagagggaagattttttttaaaatcagtattttctaagatactttacaaaatcattggattaatggaaaaataacaggatactgttaaattcttagaaattgaaaacgatagcataaatttaaaaatagtaggataattgaaatttgatgatgaattaaattcttgggaagcagagcaaaaatcaaagaatcggtaattaagatataaggaataagatataaggaaatgagaaaactatcctcagaatatcagtgtgaaataataggagttctaggagagagatcagtgaaaatggagtgggggcagaaatcactgtgaaataataaaggaaactttgtccgtttgaaggttatgagtggcacattgaagggaatttacagagtgttcatccaaatggacaagaataaactaattccaagatgcatcattctgaagtttcagaacactttacaatgagaagaaccttccaaagggaggacaacacaaacaatcagaacgggtcacaaacactttagaatcaaaacaattttagattttttagtagcaacactaggagtttgaaaacaatggactgaggctctcaaaattctgaaagaaaattatttttacctacaattctatactcaattaaacctttagttaagtggaaggataatattgtgataatgcctaacatacaagacctaaaacatttatctttacataagctttctcaggctgtgactggagggtgttctccatcaaaacaagggaataaaccaaataaactactaaggaagaagaaaacatgggattaacaaacagaggatgaaacacaggaaaggattcaaagagattccaggatgatagaaacaaggatcccaggatgactgttgcccatcatgtgtagagggcaaccacttttgattgatgtaggtttgataatatgtggtctaggaaagtgcaagttaccataattgtgtcaactattccccaagagtgaattgatgggtgtagtgaaagtcaatggaaactggcattttattgatgagagatacaatgttgatggtatgtatctgagacaataaacatattcccaacaggaaagtctacatggaagtctggtattcctttgttaactaacatcttggaaaggtgtgctgatttctatagtctgtcttctgtaggaatacatatatttctgtatatatgtacacacataaacaatctcttgagagatataaatgaagttgataactgggattgactgtgggtaggagcagcatatggctggtggagggtactgtgagggaggcttattttttactgtttatctttttattccttttaaatattatgccacatgcatatataagttatttaaagatgaataaaataaaatgtatttcttataaattaaaaataaataaaaataaagacaaataacattaactacagtctgagtaagagactattcgttttatttattactttaaaaatgtttagcacttactctatttgtaacattagagtactttgcttttgaaagttgtaaatttaaattctgttttggtttgggagagggcaaagatcattttttttttggtggtgcttgccaaatacaaataagacagattaagaatgcttagaagctgaataattgatgataggaatgatgaagcttctcttgttccacaggagtaattctatagttttagaatgccccttagtagatgtaatagaattcaagtaattctaaacttgaaaaccttgttcctttaggatcatattttcagtattaattacctggtggtcacaccatgggaagatgcttgctatggcattgacaaggtaaaagatgaagctaataaggtcaatgcgttcattcaattctgcactagtaatgtttgtcttttcaggcccttgtcccatcactcatagatactgtacagttgtttattctgaaatgtaaagagatagagtcaactttcaaattgagggaaggttttatttttaatcgaagtcgattaatgcaaaattaattgaattatgactttctttcattgtcttctattgggtcctaattctcatttattttactctcttccttattctactccgtttctatatagttattgagacatagaaaaaaagactctttgactctttccttttaatcagaatatgctatacctattacatttcctaaggtgcccatcatttatttgagtcaagatgggaggaaggtactgtcctagataaacaggatttagaatttattgcttataatgacacgttgttgatgaattttataatatttgatgctcttatgggctacgtaatccaggtaaaaaataaagtagggaaaataggagtaggtttttaaacaggaacaataaagcatcgtgggaaacagcaataggaataaattaatgtcagactaatgtaaagaagcaagatattggggttccttggtgacaatcagaaggggcttagctttttcaggacactgagtcaatatggtacactcttgtcctgctgtgttctattctgaagacatccttagtttgtctaagtgtcttattagtcattaccagttttgaggtggaggggaaaatattagactgtgagtacagatggtggtaataattgcatgggaacagaagatagctagcgtggtgtcctttcatgaatccttagagaagaataatactgttgaatgttagagtgggacagaggggactttccactttgtttatcctaatatgagtttgcagtatcacaaactggagattggcggataaatattgatgttgaaagtgacggaaaacccaacccaagccagctagagcacaaaacgtaatttattgtctcagaaactgaaaactctaggataaagctggattcaagagcttaagcttgattatcaaaatgtggctcctttcatccccttggctctgtggctgtgtttgtttcatttccagactgtgggagaacttgccccaattatcacaatcccaaatacagtggtagagggaatttccattcttatgcttaaaggaaagtctcctaattgtgtcttctgtcttcttggctttgattgacctgatctgaatggccaaccctatgactctgtttaagccaaggaacatattttaagtatctttgtgttctcggtgattgatgagcacagggcgttgcatgatgtacaggtacacaatatacaaatgttatgttaaactgtaagctgcttttctgaaaacaaccattttacattgtaagagctggtctaatatagtccagattttaattctgaaatttttttggagcaaaattaggtgacttgttggagagactgaatatgattactagaattcaagaatttgagactttctgcctgtgtgctatcaggactctgtcagaacctcacagtagaattcaggaaataagcaagaaattaaattacatatcatcttagcatgctaagagatctattaagagataagggatatagtggaagaaagagttttaatttcttttgaatcatacaaaacaaaagtgagaggtgggagaagaacatggatgatagctggaaatgagaggatttgaatattggaatatcatcccattagagaagaggaatgatgtcagtgatgctaaaattattctttcacagttgcaacagaatacaaattacgcacatcatgatcttaaaacatatgtttgaaattcattttatagagaagtttaaaaataagtggtctgatggggcatgaaaaaattttgttaaatctagtaagagaaaaaaatgacctaaaatagatttaagacttatgtgctgtgtcaattactaatgccttgtcttctgagtttaatttaaaaaaagggaattccaaagactagatttttagtgtgatagaggaaagtgtacctagctactctaaaaaataaactattcagcatttgtgtaattatgcctgtcttctaatgggaacttcattttcaaagctttttttaatctttaaattctattgaatgccaactttgcccgaacaacttttcatacagtgtgaaaagatgaaagcaaaggagatgcaattatcaatgatgtcacagaatttgaggcatttccaatcatgcctgtgtgctcattttgcataatcaaaactcactgatggggaccaatttaaaatgaatttactgacttaaacacaggatcttggagctctaattgcctgggaaactgtaagaatgcagcatttgagctcattggtcctgacataaaaagatgctgttaaatatttaaagtagtcaagagagctgtagtgtcatttaaataaatgtaatgtttattagagtaataaagtgaaacttttaggagattcataattatgcaatcttatgagagttttggttattgtgcatgagcttgaaatatctgaatgcttggaaacgtagcataaatgatctatcatattattcaaggtggtgatgtgtgatttgttgaaataaaatgtaaatggcagtacagtgtggttattgggtagagagtttggagttagcctccaaagcctacatagccacttaactgaataatattgcatatgttgactaacccatctctgctttagttttctcagctataaaatggtactaatgctatgctcgccttcttcatagagatattgtaaggattaaatgtgttaatgtatataaagtaccttaaaacagtgcttatataagcatttgctgttatgatcactctgtaaaagtcattacggtttttcttccgaatgcacaaaatcttaaaatgcaatatcagaatatgaaaaaacatatgaggaagttcgcacatatagcattgaaaagttcagtagttaactcataactacaaatttggccttttgtatgttcactccaagacacacttctaacacgattcctcacactctaggacagtaattctcaaagtgaattataccaaggatgagttggatcagaattaatagggctacttgttaaatgcatattcctggtcctcactttagactcactgaatcagaatttttgagagtgagaattagcattttaacaaatgcctgaggtgatcctaatgcaggacagattttgagaactgttcttacttgttcatgattccctctactcatgctgtaatttcactttcactctgtctcacattgcacttcagatgtcttatttctctcagttcatggttctgtcacgtctcctgttcaaggactatagatttttctttcaaaatcacagtagattgtagttgatctttttctttcacattcaaagcctagtttactaccttctccctcttccattttgtgctctcttcattgtaccttgttcatttccttgccactatttgtcctaagtgggatgtgaaatcattctggctttagaattccataaaagaccttcacctggctttggtttagctcagaactgctccccctttcctgtctcacacatgctttgctttttcccttccatttctctcatctttttcatttcctttctttccatgaacattcctgggttggaagacagggaagagtttgcagctggtcaaggaaaactcttcttcagatttcattggtcttctggcaggtttgcctggagagaagggacaggtacaaaggaagtcccaatccttcagcatctctgtccctgttagcttatatccctttcctggactccatttgaactcggcatccctgtctggattttagagtcagaagtgtgtgagacatcattgagcagtctcagactgcattgtctgtatatacttaacggagaacattgcacttaaatcctaaaatatatcaggaactcatatatttggcgtgtctaagtataaagccatgtgtagccaagtggaaacaccacatacaagaaaattgtattacttcttggccaaggtaaagattaataggaagcattttggctcatagagtatgtaatgcagctctcctttaaaacacgtgaactttttatgttcgtgtgaatgatcacatagatccacgggaatcttaatgatccgtgagggaaattgttcacatttttagaggtatatctacattacaaaacagcagcactttcaggagaccactgcactgttgtgctttggaaagcacttgaatcccagagtgctgaaagtaggaacagtattgatgactcataaacacacatatcatagtgaaaaaaaaaaaaaaaaagaaagttgtcatggaaaaaaaggaaatatatactttggcaaatttaaagcaacatggacattttcttagacgtggtcttagtattttagctagtaaaatgaaagaaatttaagtcctggaaatttatcccttctttgaaaggattagaatttctttgcaataactaagaatttaaaaaattctcaaagaagacaagtttaaggaaaaagtagacaccaaccaagaaatcaatttattgctaaaaatttggcttcaactgtttcagttttggctggtatttcgtagttttatttgtgtaaatatgggctttaattaaatttccatgttgctgcttaggtttttcttaaaatgtggatgtcaataaattttttacatgaactaaatttaataagtaagtttaacttacagctattatcttggtatagaagctaaaaagcaaaaagtacttctgaatagtagaaagagaaccgtaagaatagaatcgtgtttttttaacttctgtcgtcacatatttgagtttgatggcttaatagtagatgtatttatgtcttagttgtttgctgtctaactcttcatactatgtttatatctatagacaatacaatctaatgagaatagattagatatattttgtgaataatatttttttctttttgttttagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcggtaagaaattattatagctctatttttactgaaatagatatgacgtttcttagttttaatggcaaggattttttttttctgtttgagattttgagcagtttcattatgataaatgatggataatttgcagataatgctattccatttttatctcttacaggtttatagagtgctccaacataatcatgtatatttaacagtactatttttaaagatatagactgatcattttgtagtgttcatatatttattttagaacaagaacttttcattttgggtaatttggattgtagctatctctgctcagatatactatctattgtaaggtggtgtagagaaaacgtatggaatatttaaaagtagagaaacgacaatagtaaaaaaaaactttagttatgtccaagagctcttttagtgggaaaaattaagtatattaacttaagtaaatgttgggtagaatttgttaaactattgatctatctagcacacaatttagttactgggtggattgtgtgtgcataagtatgtgtctatttttaaccagaaagttatgtcatgtgaccactaagagtattgctatatttgagtctcaaagtacttatactttttgtttgcaaaaataaaatcttaagaaataggcttaattatcacattgtgaaatattataaaaagagaagatgaagaaaaatgacctatgaacgaatccagtgctataattttagttatttgtgacatatatctatatatagaaattatttttagagtacacattatatgagataatctttttcataaaattttgattgaatcctaacaattttttcaggttcctttatcattttcacaacttttcttaatggtgttgtaattacttcctgatcattcttccttttcattgtggttgcttctaatttttacagttacgaatgttattctggtgaaactgtttacatatattttgatttttacctatttcgaattgttaaacgattttcataggctgaattactgtgcttttctgtttgtttcagtggctcttgataactctttcttaaagcttgtgtcattttctatagtaaggtatattttccaacacccttcacaacttacttggatttctcaagtatttaaaacttaatttattgttatgtatgagaactagaaattgactaaaatttccctatacatgatttttattggtactaaatcaaatattttttctagtagcttaattactcattttgagctctttcgtgaaagagatctcattttgatcgcacaagctcatgcagaatcttactaataatactgagaatcttaccagtaatgctgatttcacagaataagatcctaaaaagttaaggaaaagtttatgatgactaaaacatttgaaatgctaaaataattagatctttattggagatgtgggagaatataagtacaactttaggttgagtttgggaaagagcagtttctttgaaactgatagggaaataattgattttcctgacacagtttttggcaggccacatacatctctttcttttccttttctcttttttgttgatatataatagttgtacgtattttgggggtatatgtgatattttaatatttgtatacaatgtgtaatgatcaaattaggggaattggggaatatccccaatgatccccaatgatcaaattaggggaatatccctcacttcaaacattaatcttttctttgtgttggaagcattataattcctctcttctagctattttgatatatacaataaattaatgttaactataatttccctactgtactatcgaatactggaacccattccttctgtttttgtactccttaaccaacttatcttcattaacctcttcccttctcagcctctggtaaccaccattctactctctacctccatcaggtccacattctttagctggatgagaacatgtggatgagaacatgagatatctatctttcagcacctggcttatttcacttaacataatgacttcctgttacatccatgtttctacaaataaaaggatttcattctttttgatggctgaataatattctgttgtgtagctgtgcatatatacaacatttttttgagaattttagctataatttgtcttattgttaggtttgctgttgtctactccagatcaatcaagagcagagaaaaaaattcacataattgctttcctatataattctttttctatgtaatatttgttttcgtttcacagcatgaacaaatgattttgtttagaatcatttcttttttccttttttttttttgaggcagagtcttgcactgtcattcaggctggagtgtagtggtgcgatcttggctcactgcaacctccgcctcccgggttcaagcaattctcctgcctcagcctcccaagtagctgggactacagacacacaccaccacgcccagctaatttttgtatttttattagagatgaggtttcaccatattggccaggctggtcttgaactcctgacctcgtgatccgcccgtgtcggcctcccaaagtgctgggattacagtagtgagccactgcgcctggcctggaatcatttgtttatttctgaagataagttttttcagttgttaaatatttatgatttttgtttttgtacaccctatctataaacataaatgtcacttgatttatgctttttctcttgattgctgtaattaacatcagttttacttgtcctaatactgtgttaaataagaatgatctatattttgcatttgatagctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacaggtaagtccgtgtttcctccttataaaaattataaggaggacttataaaacttataaaaatcttttagtgcttaacaatctatctatctagagatgagccaattcagataactggtggtggtattcatagaatccagaactgacaacctcttcagcgcttccacaatctggttattccttgatcttgttcagaaactctgcaggtagtttttggatccattcagcttactcgggaattgccatgacagttgctccagaaaactttgccttccctttggcctttttttcttttattcctcccctgctaccaaatgtacaaagaatgactgtgacttctgagatcaaaggacaagaatacaaaaagcgggcatggaagtgggaggtccctgtgacttaaattcagagtaccgctgggagaaaaacctgaatagccttaggtttaattgaactttatggcttggtttattaggttgaggcaatgactcgctaacaccattctggttgttttttctaaagaacattaagaatttttttttgaataattgtgtcactaccattaaaatgtttgtgaaaattacacttgaaacagttatgttttgctcttttaaatcattctttaaaaaatatacttttgtgctgctgttgaatatcagtacaaatgttacagaaaactctccattttataaacagttttaatgttttatcttcagtttggttctgtgattcatagaataactaattctaaagttccagtaccttcaatagcataggaaaaattacattgaatagaattttgtactgtgtacttaattctgttatattagtgataacatagtaattataactaatttataatatagtattattagccagtgattatttataattatactatcatatattattaagagtcagtgactaatggttttcaaaacttttttgaaaatttttcatttggaacttcttaaccatattgatgtaattagaatgtttacttaatctgtgcattaagattacatatgtatttttattatattctgaataactacttgaagacaaattctacaaaaataaatttttaacttattattttatttttaattcattattttatttttgggattttattttagaaaccttcagcaaatgtgaagcttggatggccaaggactgttactgtgacaatattatcaaatgacaatgcatttggaattatttcatttaatatggtatggacacaatttgatgataattgtggttgctagataatagtttattaaattttaaaaattagttttcatgatgttagctagtatcatgctgtgttttgatatttaaataaaatttgctttaactttgtccctgtttcacattctgtagaccattcatttgttctacctaagatgtttgtgaattgaggacgcttgtatgatcgtggtcatcttttgtcctaatctctttctgctgattgttccacctgactcctttgttaactcttctgtctttaactcagatataccacccattgccttttcctgatttccccaaatgtcacctaaagaaagtgttgtttgtttgtcagactcttctgaaagtttggagttaatgggagatgagaaagcatattgaaagaatacttttctttttttttaattattattattatactttaagttttagggtacatgtgcacaacgtgcaggtttgttacatatgtatacatatgccatgctggtgtgctgcacccattaactcgtcatttagcattaggtatatctcctaatgctatccctcccccctccccctaccccacaacagacgccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtattgtgccacattttcttaatccagtctatcattgttggacatttgggttggttccaagtctttgctattgtgaatagtgccgcaataaaaatacgtgtgcatgtgtctttatagcagcatgatttataatcctttgggtatatacccagtaatgggatggctgggtcaaatgatatttctagttctagatctctgaggaatcgccacactgacttccacaatggttgaactagtttacagtcccaccaacagtgtaaaagtgttcctatttctccacatcctctccagcacctgttgtttcttgactttttaatgattgccattctaactggtgtgagatggtgtctcattgtggttttgatttgcatttctctgatggccagtgatgatgagcatttcttcatgtgttttttggctgcataaatgtctccttttgagaagtgtctgttcatatcctttgcccactttttgatggagtattttttttcttgtaaatttgtttgagttcattgtagattctggatattagccctttgtcagatgagtagattgcaaaacttttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacaggtaagtctttaatctatcttgaattaatttttgtataaggtgtaaggaagggatccagtttcagctttccatatatggctagccagttactttcaaaaaacttactatgaacttaaattgaatagcaggtattacatctcttcaaaattctgtagtcatcccaactcttaggttttcccattaattaatattttctgaagattgaaacttcctttcatttcactcacctttgctcaatagtgtattttctgttccttaactgaattcctgtggctctggccaatcctgtgatcagagagttttatctttagaaacaaatacacaaaatagggcccttcttgagataaattgtttccagctcctaaaaccaagtttatctccaatacaactgaatctggtcgctaaattttagactccagtaacattcctgactcggagtctccttgaatcacattactaattataattaataaaacacgttgcaatacttcccagcttttcatttatttttagattgctactacaattggttgtattgtatgtcattttcttggtaccttaacttatctttgaaagaagtgggctataagtaaatatgatctttatagtgcagtatctttgttaaaaagggtatttggccaacctcagtttagtagaaattcggtaacctccattatactgtcatttacagacattaagttaattaatcaaccatctcttttatttgaatgataaggaattgaatgataaagaattgttaatgatgaagcaggctcccttaattgctaaatttctctccatgtggctttcctgctacacttactctctgtgtatcacctccgacctcatactgatttgtttaaaggtttcttttgttgttgttgacattatatatcttagcctatgggaatgaatcctagtttctgtcatgggtcctaggtccctgactggtgggggtctcagtgctgccaggcagcctctgacatccttaaaattaaactaaataaccattgagctcacggtggtgctcaataggctggctttgcttttcagccctgaggatgattatgttggtagtgaagatgacattgatgatgatgataataatagcaacatttactgtgccctcagtatatgtcaggtactaggataagcacttgatgtgaactatcgcattgaaacctcatcacaacccttcaagacggacattgctaaccccagttatgtatggggctactgagttttgctgtcaccctgagagctggcagctgcttctgtagcctgtatgtacttggctgtgtccgtgttcctcctcttctaccctgagtttccaccagctgaaccagcatatttcttttgaagtctttgctttcacctcctgcagagatcctgtcctgaaagttattagcagtgtctgcttttcactgacaagctggctgatgtggagaaagagtggttgtggacaaggccaagtggtggtcccagtgacctgctgccttggtctggaggcttaattcatgtttgtgacctcctgggcccctgtgagcatttgagtttgtcacctttcaactaaaaaacctttaaattcctcagcagaacagctagttgatggtagaaccaggacaagaaaccacatcttttgcctgactagtttttatgttccctttacactattctttttaactttttcagcattttaaagctatagttcattgatgctaggaaatatcacattcttatcgtacagtgtggattgatgtgtctgtggaaattgagcgtttctgaggtaatagtttttaccgcctcatacctctgattgctcagctcctgatcatctgtgcttgctttcctcaatagcttccctcaatcgcagtgagtgagcccaagggcagaaatgagtctatgcctcttactctcatcagggaaaagggaacctatggaatggtcatggtgacttttgaggtaagtttactctgaagtcattttattttatttatttttatttttatttatttatttttgagacagtcttgctctgttgcccaagctggagtgcagtggtgcgatctcagctcaatgcaacctctgcctcccaggttcaagtgattctcctgcctcagagtcccgagtagctaggattgcaggcatgtgccaccatgcctggctaatttttgtatttttagtagagacagggtgtcaccatgttggccaggctggtcttgaactcctggcctcaggtgatccgcccgccttggcgtcccaaagtgctggggttacaggcgtgagccactgcacccggccctgaaatcactttaaatgcgaacactggggttcataccagatggctgcaattttgaaaatcaaagttccttgtataataaacatgacacaatacaattaaaataaagatgaatacttttctgatctgatacatttcatgattaatataaaaatgttttccttgctgcttgtgtatacaatgcttacatgaaatacaagtaacattttagatatgtgggaaaaataaatcataggatagaataataatgttaattctataaaattcatggaacttttatgataaatgttttcaaagacaggaaattttaaaatacccatggattacttaggtttacataaaattatttaatatgttgtctttctctattttattttattttattttttttgagacaggatcttactctgatgcccaggctggagtacagtggcactatcatggctcactgcagcctcaacctcctgggctcatgcagtcctcctgtatcagcattctgaatagctgggagtacaggtgtgcatcaccatgcccagctaagttttaatgttttttgtagagatgaagtcgcattatgttgcccaggctggttttgaactcctgagcacaaatgatcctccctcttcagcctcccaaagagctgggattacagtcatgacccaccatgccttccccctgccccccatttttttcagtacaccaaatggatggtgtttgtagccattgcactccaccatgggaatccataaatgttacaggatgtggcatgaatatgataagctgtaggtgaggtgtatttttcaggggctagctctaatcattttatttgattgcttactgaccatgtgccaatcattgtgtcaccacattgctgttctatgagatacacatttaaatcttcaactaatttttgtgttttttaggatccacaacatgattatatactattttcaaacattagagtattagcaatttcagataccagtttctttcctaattattaattgtaatatcaataaaatggaagcatatttatttaacacaattctatggtagcatagaagagttctgttcatgcttgtgggtgtccacatcatatggtagttatgttaactacacagaacatagaatagcagaagacaataatgcatgaaaaacacagtaaacactaactaaatatgcagtagtcttgcaagttttacactggaagcattacacagtttttcaggtacttaggaatatgcatttagacaataaatttttgaaaatttttctgataaatattggaaaaattagaaaataattggctgtagaaaggataaatcatccagagtagagtgttttcaacttatctatggatgtctaaagttattttatcaggtttgtagcctgttttttgtttaaataattataagtaacatttttggagtgcttaatattgccatatactgttgtaagtgctttatattgattattactgcatacgtatagcacccctccctggcacttgatctctctcatgctattcttaattttttctctatgatacttattatcatctaacgcatacccattcatttatttatcatttattcccttcctttaaatgtcaggactatatggaggggaatttgctgtgttcactgctaaatctttagtacctaaaagagatgcagcatagagtactcaacaaatgcttttttaaatgaatgattttatttattcttcacatcttcacatccagcttgtgaagtggaaaatactggtattacttgagggaatttactaatcttgaataccctttcttccaagaagaaatatttgtagagttttttttttcccctcaggtttaacataatggttgagaaaaaacagctcgtagaaaccacgtagtttaatgcagttatagtcaatatctataattacgttataggacctattaatttgaagggcagaatgatgtatgggttagtgtaattcttgcagaacatctttaaacttcagatttttgtcagctgacatcacaatgatgctttctcagtcttgtgaagtattttgcatttattgatggcattttgtgtttctttgcaggtagagggtggcccaaatccccctgatgaagatttgagtccagttaaaggaaatatcacctttccccctggcagagcaacagtaatttataacttgacagtactcgatgacgaggttggctaatgttacatacccaaatgggacaaggattctgtgttgcaggacacagtcctgtataaacttagtgtattgtggccagtcgcacctcagctataaatagctgactgttctggaatacatcttattactatttatcttacttaattcacattaaattacacatctaaaagctgatgaatctgaatataactggcaaccatacatcatacaaatatttaagcattttgtataccctggtaatcaatttttgttagtgctttcaattttgagcaagaacaatactaacctagaataaatattttaccataaaagcaaagaaaaattctactgcagttggtattcttttgtttttatttttttgttgttgtttagaaggagtctcgctctgttgcccaggctggagtgcagtggcgcgatctcggctcactgcaagctccgcctccagggttcacgccattctcctgcctcagcctcccgagtagctgggactacaggtgcctgccaccatgcccggctaattttttgtatttttaatagagacggggtttcaccgtgttagccaggatggtctcgatctcctgacctcgtgatccaccagcctcggcctcccaaagtgctgggattacaggcatgagccaccgcacccggcttgtttggatatttttaatgttcacatttatgggaagatttttattatttttatatttcacattggaactagcaaggatagagatacatgatacacctagcttaattgctaagaatgaatctgaacaataatgtgcaaggatgtcccccacatgagctaaacgagagaaaacatgactttttataaaagaaactaagttttgccagaaaagaaaacaaaaagaaaatagctggcaatttgtaaccctccctctaccctcctacaaaaattctgaaactaaatcacaagaaaactcaagagaagggaaaaaatgtattagagtattagaagacattattagaaaagaatttttctcttgaaaaaaaatgaaatatttggaagcattgatatctccagttcctctggttctggaagcaagcaaaaaaacctttttgttttaagatctcagagcattgaacgggctataatttggggagatgattaattatacattttgattgtaaatttgaaagatcaatcgaatcataacattttatttttaagataaatagctttgctttttatattgctgctgatggaggtaaaagcatgcatttttttcacttttatttctaaaatagagtttatggtgaatgaaaagctcacacagcacagtggagattaaccccaagatttctctgcagcagcataaataaaaggaaaaaaaaaagaaagaaaaaaatgaaaagcaaaaattgcactttaacagtgtcagcatttttcctagtagtgactcttacagctttttctccagagaggcatgatgtgtatcttgaaaagcatatattggtgtcacgtgtttaactcctgaattaacaaccatttggagaaaagcaagaataattcacaaggaaaactaacaatttttatgtaatgtttaacgtactttccagattcttaggtattattagactttcagtactacttctaagcatatcaaactgataaaactgatagaaatgtatgacagttttttactgtttaatctttggagttatctaaggaccagttaaggctgaaagacattatacctggacttcattacttgtactattgcttccttacgttttcttttcctgtgtaaaatacattatttacctgtggaaaatattttattaattggagactaaacaagcctttctatttgctccctcagttaaagaatttttatttctatgtaattgtattgaaacataatgacttgttacactttagtttatttgcaggtgttttggctgttgatgttttgcctctgtttatattcctttaacaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaaggtatgatttattttaaatatattgctaccattattttattatattattccagatttaagttttgtggtgttggacacaacaatgaactgttagaatatgtgtcattttttcccacaaagtttcatgacaaactcagaaaagacacacacacacacacacacacacacacacacacacacacacacaagaatatgtcattttttctaccatggcttcactgttttctttcttatttggagtgtgatttaattatgcaaatgattcatagtatagtagttccctaggacacattcacatatctacaccttcatattaaaaatacttttttccgccaggcatggtgactcacacctgtaatcccagcactttggcaggcttgggggaggattttctgagtctaggtgttcaagaccagcctgggcaacaaagtgagaccccgcccacaaaataaaataaaataaaataaaataaaataaaataaaaagattagctgagtgtggtggtgtccacctgaagtcccagatacttgggaggctaatgcaggaggattgcctgagtccatgaagttgaagttgtagtgagctctgatcacaccactgcacttcagcttgggcaacagagtgtgacccagtctcaaacaaacaaaaataacaaatcagttatttttttgttgtatagattctgtttttatcagtgtctaatggacaacttgacattgggaaagcttatctaagggaaataaagtgtactatgtgacaatatgtatttcttttaaaacatttaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggaggtataacccttgttatgctttatgcttgttaatatttctgtgctgtacaagaaccaaagaatttggtcatacacatcaactttatgtttagtttgaagggacaggaaaaacactggctttgcaaatgatagttttcttactcagtattccttctgaaaataaatattttaccctctaaaaaattccacaaactgtgatttaggaatatttccaaatctgtttttggttcatcttttgctctattatgtataagaagtcatcatttttagacataaaatattaataaatattaaaattagaataacatggaaaatacagagtttgatcatctcagatgcgagaattctgtactttaatattttattcctttacttcagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacaggtacttgtatgattaaaataatcgtaattttggttaaccttcaagtgtactaacctgtgtgaaagaattaactgaacattattttgaccttgttattttgccgtcatttatatgttgttactaaaagttgtttaggtagtcggaagagagattatgcctgctcctaaggtatataagtataaataagacaagaatttttaccaaagttaatattttaattaagtgacattaaaagtacaccagacgtgaaatgccagtcatgcaagtcagactgtcatggatgacatagtagagtaacttacaaactattacaggggagggcgagagaaagagaggctaaccatgctttgaattgatttgggaaaatatgacataggaataggatttgtaggataagtatgttttcataatgaatattgcaaggaaaatatttcagaaacaaagcaatatgagatatatattttttctttttttttgagacagggtctcactctgtcacccaggctggagtgcagtggcggcatctcagttcactgcagcctccacgtcccaggttcaagtgattctcctgcctcagcctcccgagtagctgggattatagatgcctgtcaccacacctggctaatttttgtgtttttagtagagacggggttttcccatttttggccaggctggtcttaaactcctgacctcagatgatccatgcgcctgagcctcctaaagtgctgtgattacaggtgtaagccaccacgcctggcccaagaaaaattttataaatacttttaaataatatactcaaaaatcaatttctttgtctaggtagactctctggaccttcaactgtttagtaaagtccccatgacgtatccttccattttatacatttcatttcttctgttaaccaaaatattatttttatggccaaagtataaaatatctgcactcatttatgatactgttgttgttttccatgtgttgattgcttgatacttaaaattctaaatcaataaagggtacttattaaattatgtaaatcaattaaatacagaatcaggtagtgtgaatggactgacaaggaaagagctaaaatcttatgttgccatacattgtgccaactgaagtatatagcaaatgaaatattctatttcactaatttctttgaatcatgccacatttaaatatgtttcatattttgccttgattttgttttatgatggatttattattcctttctctggagtttctgattgtcccttttctgtatgttatcttcactatattattgagatcttgctgctgtcttcctgtgtgtgttgaatgttgagtttagctaaactaactgctttctgtgcttgtttcacatctgttgtctgggatttttttactgagctcctgaattttcttgatctgttgcgtttctcttttgggattatgctgtagttttgttgtagtatatctaccctcaaacaaatgtgctgaaagtatatatgtaaggtaaactttttgagtctttgagcacctgaaatgtgaaattttatactcatattgatagtttggcttggtagaaatttctggattaaaataatttattcttcagaacttgaaaggtattgttgttaagcttctagagttgcagatgagaaatttgaagggaaggaaatgatttatcttttagataactcgatctttgtctctgaaagctttttacaactgttccttggtgttctgaattttgtaagactgtgtcagcacttggtagggtgaccgttttcattttgaagactcccgcgtttttttaagctgagcctccaggcatacttgtgctgttagggcatttttcgaggactcttgtccaaggggcttagtgggtgacctgttacggggatgtaggatttgtcagtatgtacgcgacacctttttgtaatatacctacacagagggaggcatttgccatcttccccagagccctacactaatggcagtagatcctgatcttcatctttattattattaatttttgttttcttgcgtctcctccaagcgggaaaattttcatgtgatgcgagcttctgcctgtgaggataacttactctctggaggacccttggatttttcttggagtggaaagatagggaacacggctctattcacaattgtgtctggtttgtcctgtggcttgtggatgccagggagtctggatctgtgaagtgaaatactgcaaatggccacgcacatgacttgggcccttgtgagcattaagttaaaacaactagaatgctgctaccagaacacatttagagctatatttagaaactaaaaacaaaaacaaacaaaaaaatctctgactttatacaaaaacatgacataatttgtttgcttttaaaaattgattttattaatatggaagtgcatattgattttaccagttcacacttagagtagcatttctgaagtttcaagactgtgtgggattcaattttttgagtttcagaatttaatggaatttttttgacattagcacttgtttgtcttctctgctgtcagtgtcctcaggtttcagggtttcagaacattcccataagtatatgtttaagggctttttttgggatttttttggtcttactgttctcccttctgtttgtctccagtcttgcataatctacaactcatgcaagaaccagattattaaaacaagtggaatgagacagagatttttacacagttgcttttgctttcatggaagcctgggcattctggcatatgtggagtagttgcagtgatgtgatagaagtttgagaattgatgatgcagaaatgttgttttggagttacagagaacgtttttgttatcatttgagctttctaatgtcttttctcataatgcctcaaaactagtttttactgtggataaggacagtaaaaactgtgctaatatataaaaaaatctgtaccaatatcagtatcctctatgttaaacttttaatcttttgaaaaagtccaatatttctatccaagtaactgcagagaattcttgtataaatacatccttattaggaactttgtacaagtcagatattatcttagctactctgcttcagcattctatataaacatgacaattaatttttgatgacacttgaaagctaagaaaaaagttgaagaaggatgtaattaatatctgatttttggtgatcctgggttagaaagttgcaccactaatttcagactcaattctttatgtatctatatagttaaaaccaaaggtcttacagtgcagttaatttatcacttgcttagggtgaacaaggcattattagtcactgacacaagtcattgaggttcaaaacagctgtaggttctggaaggctagttggaataagagggctgtgtagtttgcatagtacataatggatgagcaactcaagaataggaagcctcagcctctgcatgcaaagttgaatgaaactaaagaaagcagaattctttagtcgctcctcattctttagtaaccctctcagctaaatacgttagtctgagatgcagcttttggcaagcatggggttactaatgtgctgtcccagtggcaaactatctgaaataaagaatgattctttatgaatgaatagagcagtttgatttagcagatggaacccagacagacaaaaaaaggcttataggctaggaaataagccctgtacaattaacattttcttttccatcagttcatttcataaccatctacattttctttctatttgtcaaaaatcctatatctaggattaattctataacttttttgataagtgtagggaaatatgacttatatatttctttctttttagaaagttttgtgtaaaaattattgtttttttcttgatgcttaacacagtattatcagtttagctctttttgaatatacagcaatgacaatgttcattcacgaatgtgtgcttggtcatacatgaccagtgtattttagaaatatctttgccttataacaatgcacacccttatatttatataccattcaaatatacatattttatttaactttgtgctattttgtaagataaataaatatatatgtgtatatatatatattccttttctctagaaagaatgacagttatgtgactttaattatttatctttacattttatctacattgtaaggtaaatgcagtatactaaagatcacgttttattttatgtggcttcatctatatgccaatacttgacaaaattgatcaatctaatttttttcttttttcaaatgaatatttaccaaaaccaaaattattcatgtctttctcctgtatatgattttttaaagcaaaatgtgtgacatttaaaaaagacatttacttttactattaaaatgtactatccatcgcaaaataggagagaaatcagtaccagtcctgtccacgtgtggaaaatcaatttaaatcacaggtctactggtgattacttagtgtcatcatttcaatattataaagcctaacagagggctttaaagagtggcagagacatgttttattaagttaaaagttgcattttattttaatatttaaaattcctatggtttttgcagtcctgtgacgattacctattcctgcattcctgaagtgaacactgtgtgcattgattgagaagttaggttttgaaaagttagaatatttaagacgttgaatgtttgtgatttatcagaattcttatagagctcagattgtgtagaagggaggaattaacaaatatttattgtgaagctgctgcagtttcaagtctatgtcaagcctacgtcatgtattgggaaaatgctgaaaaggacacagacccacaagagctctgcagacctgttgggaagtaaaaatctggaatgaatcaaatgatgagaaaccagcaatatgtaaaatgtataactgcagggacactatatgttatacattgcagttctttaaatgtaaagatgcatgaagttataaatggagttctgagtagtcttctgatactggattttgtctggaggagaagggaaatgggggatgattggaagtgtgggtcagtggaagacaggaaggagatgtggatgactctctgatatttggctttaaggtcaaggtagttggatgtaggtggcaaggaggaaaagcaggtggtggcactgctgatgatactagtgaaggggcatggaacagggacagtgatttctgttttggatattgtatatgtaaggtgtttgtgtgacatttatatgatgtctgtggcagttagttataatgatttggaattagagggagagatgcagagattattaaggagcaggcataaaattataagataaagggtttaggcagacccttggggaataataacaattgaggggcagaaagagctccagaggccagggaaggagattgaaaagggatggtgaatgagagaggaggagaataacattgcgaagttattggtgacctctacctacgcttactttgtcaccccatgctgttaagcttttttaaaaaatttatattctatcaattcttactactttttgtgtatttgtttattatagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtaagtaggctctttcttactgatgggggctaatgagtatgaagtaatgtacagacactatttttaaaataagatcagcatatagggttaacatcttaaaaagcttcagcatgtacaagaagccttcagtatgtcatttgaaataggtaactgatgagtatgtgatttttccatcatcgtttacagtattagatagaatgaaattggaattaattgctcacagtgagtgtcggatattttgatgtgacagctttcagatagttctatgacattcgatactacagtggtagccaaacataaacttttttttttttttctttgagagaggattttactctgtcgcccaggctggagtgcagtggcgtgatctcagctcagtgcaacctctgccccgggctcaatagatcctcccacctcagccttatgagtagctgggactacaggtctgtgccaccactcctgcctattttttctttgtatttttagtaaagatggggttttgtcatgttgtccagtttggtccccaactactgagctcaagtagtccacctcccttggccttccaaagtaatgggattacaggcatgaggcattgtgcctggcctataaacctttttttttttttttcttaatggccaagacatggtaccacaggtgtgcttgacctacttcatttctgagcattccatatgcttgggttggagtgaggtggccaggttgggccttatgcttgatgatggagatgatagtggtaaagttgtggaatgctaaatcttaagaattttttactttatatatacaatatatgtaaatttttgcatatagacatacaaaacgttcacatgcacagcaccccatccctccccttgcccccaccccgacatgccctggttgaatttttctcttagggatggctcttccttcagccttaccatttcctgagtcatagttgatccctgagaccttctccaagtcccccacacttaaatttgatttaaacctagttgaggtttggatcagaaagaaggagagctgtttttgttatcaaagccttatgttaaaatatggtgacctcaatttccattgtatattagcttctataaatggacagagaagtttcatttttcaagatggttttgatttttcatatttttctgaatacactcttttcttcttaaaacggaaaagcatttagtttgctcttaaagagttgattgcttttatcttagatagctgtaaatttaccgtttcatatttttcccttaagaaaaattagcttttaggaagttttgggctccttggacctgcattcttccctgttgggaaacagcagaaaaactaggagttttcctttgtttgttccagatacagcctggatgatgcccactccctcaaggtgattcagggccccagccctctgttataagaatctttgctcactagtctcaggttatgacgattgttagctgaagtagcagaatgattaatggagaaaatgtcttgtttttttttttccaagatgagcttaaagggcaaagaaaaaataaaacaggatactcctcttttaggagcataaaaagaatagtgtaatctagcattaaatattcctttatattcctcctttgaaaaaaacttcatcatgatatgcagcgatccttttattatacattttttaaagtgtactgcccttgaatgaaacctccaaatacaatttgtttcagaattattataatagcttccatttatttagcttatactgtggagaggcactgtcctagatactttacttaaacaattcctaatcctcaccacaaacttgccaaatagggaatcattagctttatttcacatgagaaaattaggatcagagaggttaagtaacttgctcaaggtaacccagagtcatgataaaaatatctgattttatttctgtggtatttatcctattggttagaattttttttttaattttacccccatcacttaggatgtattttatatgagataattttccagttttaatcaccggagtttatttttcagtttatattgtgatagtaagttcattttattttcagagaacctctaatggaaatatattctttagcaagattgctgtatgtttttcacaattctttgggttttaaaatatttgccttttattaaggcaaacccagattagacacatttttgggtgagggtagttttgtatataaatttgattagcaaaaattaataaaaatatatctaaagtgatttccatgcttaaaggattgtttggttgtgttttaatgcatttaatagttcgcttctctatatagaatacatatgttcacacagtaatatatgtacaaactaatatcaataccaaagcttatataatttctgaacatatattttagaagaaattgttctgttcttttctttttataaggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacaggtaataacccatttaggtaatgtttagtatcatttatgtttgagttctcttcaataactttgattttttttttactcttttttttctatataaagtaaaaaaaaaagtcaagtaaatagtgttatactggccttcagacttttctgttatttgttgatggcttctgattagactatgagtataattatatctttcagtgaatttttaccctgcttttcattgtgaagaagcactacagagagaatttatggaaggtatcagataaatatgaaacatagctaatatgttgttatattaaaaaaaaaataggcaccagcaaatctaaaatgttaggttaagcaaacagttctgctggctttatgttcaacagaagagaggactagagcttgtgagtaaaaagaaaacattaatcttcatgtaataaaattctcttttttacatggaacttaaacattaattttatgattattttctaaagaatcaaaaattgcacaaaattaagagatactttttcagtaataaataataagaatcaacagcatttctcagtgggtaatttatattaagaaaacttcacaatctctcaaagagttttttttttcagtttttcagaaaatcctttctaaatatataaaatactgtgtttaatgatttaataattctaaaaaatcagaatcagtcttatccctaacacaagtctctttatatgaaagttgattcatattagagaaggttactgtgacttgagggctttgtgcaattcatatttagaaacaataaaattcaagataaattcaagggacattttgtgttacattattcaggactaaagtagtaagttattttatatagtccatggatctctctataacagtgtcttatagatttttctttgtagatgctttgtctaaacacatttttaaaaatctgatgggtaactgatttttatttttatgtgaaagaaaagtatagaatgtaagcaacaaattattgaatgtccactgttccttttgctttctttcaaaaccacgttgtgtttacttcctttcttacataaagagtaaaacaaaacaaccaaaataccaagcaaacaaaaaaaccaaaaagcaaaaaccaatttacaacacacacacacacacacacacacacgctcgcgcacacacacacacagagtctagatgacttatggttttaatatatgtttcagactcgatcttaagaaaaggtatttcatacgatgaaaaaatcagtaaaatgtaatgaaatgtaaattggaaattatttttttcatttttgtttttttccttaagtaaggtgtaagcattcagtggacaatcttgaaaacaactaaagaaacagaaacagtgatgataaaccaatgctgtgggaatctgtagaaactttgttagcttagctgacagtttctactctcaactaaatgtttaaagaatgatttacactatccatctgcaaattgatagtgactattctttatattctttctaactattcatttttaaatcttatgtaaacatttgaaattaagtataatttttaagggtttattttgttcttctttttctatcccctatgggtaaaaatagtacatagtaaaaaaagtacataaggaagtacaaatcatgaggtagaaaatttcagaaattattggttcttttcaaatagaggaaattagttcaaatatatattaaaatgttttaatttgactagtaattggtgcatacttgtattatctcatttgtgtgtgaacaagaatgagcaaattacatttgagtgttcagaaacatttagttaaataaaatttagatactgtattttatcaaaaactccctcttaattttgcaaatttttaacaaaacttgagtgaaagaataaatgaatgatagcaagcatgattacaataaatcacatcacaatattgcaatgaaaatagttaacagtttattgtgataacagtttataatttcctctcaatgtcaaatccaagttcaaattctctatatttcaactcaatatagacaaaagttgccctgatactaaaaaacttgtggtgctttcaaataacatgctggttaaaaatattctatttagttttcctcaaatcacaaacaatgtcattatgccagtttatttcagaaaaattttggtgtatgtggtatataaccctatatttataaatggtgcatttgactttaaaaatgaagctctagggctctacatttgacatgtgctttcaaggctgtttgaaaatgaaatacactgtggatttggaaaagtgttttggtttcctgatgccaagttgtatttaagtaatttttggcagaattaaaaggtgcaatgatatggcttcttcagtatgttcctgtgcaaatgatataggtatagatttctctagttacacagttttgttttttctaactcaaagaacaactggctttagatctgagactaaaggtttttatttttttttaaatctaattaaagctactaagtaattataagcagggctgaatgaaatttgttcagctgctgtggtttgtgagcctgtacagtgcttggcaggcacaggcgccttggaggaggcctggaaaggaatgtcttgaatgggtcttgacaagcttgctggccatggggtcatcttccataagtgggaactgccgaacctcttgctagcatttgtcaatagcaaagaatccagggtgcagagttcccataaaacgcacattactagctcttgggaaaaaaggaagcctttctttagctttatttttcccttgccattctaagtttctcacagtattagtgagattttagcaaatggtgccctgcctcctttttccccttcccacacttctttctgtgttgacagggtagaaactgaaaggtttgtcgtgtattttgggtaagtgtacaaaataataccttgtttttggtgattcagtattttgttttgcaagtgattgtttttggacgagactgctgttctgcatgattacaggtcttgggaaattttgcttgtccacctggccatgcatgctttgtgtgcagtttcattttctaatgataaggggagcttacacaaagttgtttatttatttttggtcctaagagttttgcactgtgaatgcatttaaagtattttgaaatttgagaattagtgtaatgacatttagacgaacttaaaatttttaactttccttgtaggtccacataacctcaagaacaattactgtgctgtacttctgaaatttttacccaatgtcttttatgaatcttgtagcttgtttaacagagaattagcaatcaattatctgaacggttccattggttttctgagagcatctaagcaatttattgcttatatctcagagccgtatacagaacttttcagaatttgcatttcacttaagggtagcatattttaagaaagtttaaaaataaatttgtttaatgttcagaatggatttttatattttgcattctgatccagttttttctttcctagcttatgtggatataagaaattttaattaatgaggatattgatataaatgatggacaaatttggtatgaaaattatgactgttttaacaatataaaataactctcctattatttagactattctgtggccactagcatgctaagtattatcagatttctaaaaactagggaaggatgacaattcagattctctgttaaataggaagtgagctttttttctacatatttctacatatgaattgtggtttcattgtgatttgaagtctgagcatgaatatatttttggttcaataggacgtgacatttcgcaaggtttagagcagcttgcaggattgataattcttaagagcctgctggcttttaaactctcagaacattgcagtccaagtccctttgatcattctaattatgctttgaacgttaaaaccagaaatttaaaaaacatgttgttttaatatgttcttttggagatacgtaggaattggtataacatgtcatgcatctcagatctattctattcttttttttcttatattccctacattttcttttatactaaaagacaaaaaagcacaggtttaaaattaaggagaatagaaggcatttgaaaccacaacatattcctaaaatgtaatcacaattgtgtttattttttatcagcgtggcttgctttagtccatttagttatccagctattatgtgctctattcagttagtataatcttatgtaatgagttttaaaaataaattcaagtgtatgtaaaattgaaacacaattttgttttaagctatcttctaactacatgttacaaattaaatttttctaaaactggaatcaaatctgcaaattttgatgctttatataaataaaatatattgataacatttggttacagtattcttggtgtacatatgtagtgtttggtttttgtcaaataaaaaaagatgtaatgaattcagaaatagaagttctttcataactgttatgagtaaaactgttttgatcttaaatgatttcaacacacgtgaattcacttaaggtctaattcctcatagccttccttttcattatctggaagagttgtaaatattgccttaaaagcctgcaaaattcagaagtaaaactggaagtagcgggtgccatttgtctctctgacttctctagggttaacgtggaaaaccaagtgctgaaatctggatatactagccgtgacctaattattttggaaaatgatgaccctgggggagtttttgaattttctcctgcttccagaggaccctatgttataaaagtaagtacgaaaaaaacttccatttattctgtgctcacaactttagaagaatgatctcaaagggtttcaacttttgtggatttgtttttaaaggaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagaggtatgggattttatattttctttgtgtttctctgtaagattgatagtatttggtatattatgaatataaatattttgaatattggcaaagagacaggaaagaggtgggcaagaaaagactgagaagtacatagatttggaaaatttttaacaaaaggtttaaaaatgaagactcattcatattagaatggtgtatttttgctccacatgaagaaataacaaacaatcttagactttcagtgtgtgatcagttttcatctccttttagctttattcatgttaaggcttcctttaggtaatatgtattgactgaacttttaatgatgtggttttaaactgaagaaattttgctatagaattactttgttcaaaaaaagaaatttgagttttatattaatggaaccaggtatagttctattatgcttactcaccaatacatatgtaactctaattttattttattcacttttgtaagtttaagtgactagatcatcagagataacatccacttttcttaccattttagagtagtatcattgtttctctttttctctttttggacaatgtatacgtatttctggtgtctcttaattgataggagaatgttaatttttaaagaaatgataccacctcttttgtcctttcagtgagttatatgcttctgaaactttgagtatattaatattcttgaatatttatgtttttaaatttgttgtgaaaagtcaactttataatttccatactttgacacattcactttagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtggtaatttattctgtgtcttatattgtatttctgtttactgaagaagaaatataatttttttagttatttctttagtaactagttatttctagttgctcaccctgccttagaaattacacatagtgcggaagttttttttagaatcatatttaggaccatgatttttatttcttacatagtatcgtgatgatactgatgacttcagttatattttgataccatttaagcatatgcagtgcaactcaaacactcaagaatgagtccatccaaatagcgagaaccttaaaactaagaactactgctacggaactgttgaggtgactggaaatgataaatagtttatttttagagcagtgtctgtctggataaggaaatcacacttgagcatgcagcttcctgtaactgcttttagcagatatccttacaggactttatgataggtgtgcctaattcgtcatcattctgtttcccatgccaactgacttctaaaatcccaaactagaaaaaaatgagtccatttactttatttattatatacctacagagggaggaacaggctaatatatttttatatgtaccttaaaaactgtgctaagcaaatagttggcagttattaaaaagaggtgttgtttttatttttgtttatttaaccgatttctttactcatcattttaaaagtttcgtatgtcttcatatgtattatgtatgtttccatttcacagctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgaggtaaatattgcatataactttctgccttacttgttgtagttgatcaataattattttttattaaataattaaacatctggtaatatattttgtgataaaagtttgtaataaagaactcaggtgtgacagtgtctgaccataaaccagaagagcagtattatgttttggtttccctgaagacatgttgaactctagaactgagagtggtcagtgacactgctcatgtatccagtatcagggattcttagttggagaggcgaagccctcggcttgtatttagtccctttgaaggcaaggtcatctatcaagtgtcctgtggtgcagtctcagcaccgggacacggggtcgcatgagtcatggaccaaacatggcatttcttcttacagatagtaaagagaaagatcttaataacaacaggaagtgaacctttcctaggagagtgacacttagaacagctgtggaggccagtcccctctccctcagacccattcctcaagagacaaaattcgaatacctttctgttttagggggaggggagcaccagttcacagggatgacgtgaaaaagaaacagcgtccacctggggatccatttaggctcagaaatgtggggaatcaaatcttgttaggacatggagtgaggcctttatgacccatgcagttaaaacttcagtaaggtttgtaagaagcctttgtgagctggctgagctttagttactctaaactctgctctaaatgttcaaaaagttatttttatgtttcatcttaaaaatcaacatgtctcccattttcctgcagaaataatatgacctctgtggtatatcagtttttagcttatataaggcaaaatatctatatttccattaaatttcatagttagtctaaatgaagtggctgtttgtatgaatgcacatgaaactaatttttgggggggtctgagtcttacctgaatgtgttaggggaagttctgcctccgaaaaggaaatgaataatggtagtgttaatggtgcttttttaaaaaaactgaataatttaagaatatatgatgtaatttatatgtataagtcacctgacttaaaacgtgtaacattttccaaagattccagaagaaatggaagaatttaccgttatcctactgaatggcactggaggagctaaagtgggaaatagaacaactgcaactctgaggattagaagaaatgatgaccccatttattttgcaggtggtattgctgtcttatttgaatgagtttacatatttcttaaatagtatatataaatgtatatatgcacgtgcatatatacatttatatgcacgtgcgtatatacatttatatacatatatatttagcaatttttttcattgaacattttcaataaagcacaattgatgcttgtttaaagattttgtaattcattcgaggattgttatttaattgttcgaagttttgactaatacttcaaaaattttttgaagcaaaaagaaaataagtactgttttattatctttttccccctttcagatttctcggtatttttttttcttttgtgcagaaaacacttctccatgtgatttcttcaaataaacagtctagttggttcagggctagattatgtattagaaggacctgagtattatgcctaatggatggccatacactataataactaatttttaagggaaatattaattaaaatttcttcgttttgccactttaacgctttcttcagaactgtctttggccacctgaggcatcttttggttttgtttatgaaacggttgttgtgtaactctttcttgaatccttgttgtcagctatatatgggttaatttacctaatgcaggaattgcaggaatcttgtaagccttttgtattttattgatttgtattctttctttcttcttctttttttttttttttttgagatggaatattgccctgtcaccaggctggagtgcagcggcgtgatctcggctcactgcaccctccgccttctggattcaagtgattctcctgcctcagcctcctgagtagctgggactacaggcacacaccaccacgcccagctaatttttgtatttttagtagagacgggttttcactatgttggccaggatggtcttgatctcttgaccttgtgatctgcccgccttggcctcccaaagtgctgggattacaggtgtgagccactgcgcccagcctgatttgtattcttaaccttcagttaatgtgtacttaatgaattagccttatgttcaaccttctggtaactgctgtgacaaatataaaacataagatctctgggcctgttctcaaggaagttacatcctcaacttagaaatgaggtttatgaaatagtaagcagaggatttgaaatagcatgcaatttgctgagaaattcgatgttgaagataatggatttttgtaggattaaggcaagaggatggccattgactgttgaaataatcagagggtagtcatgtcagagttgggaacagagctaattattttggcaaagacacagtacaaggcttctctcttggagggcagggagaagcacaatgtgatctgaaaatatgtgatggaatcagaaaagctcatgtgttctttctttgtggatatttcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtaagtaaattatgcttttttatggcagatctgcctcagtgctttaataagatgaaattaagcactgcagtccaataatgaggacaagtagggcctaactacatttgtactattcaagagtaaaattatttcattgctttcttgagaaatggggtgaagaatgtatgtgttgaacctttatgtacttgttgaacctttatgacatcctttttaaccttttctttatgatatggcacaaatagaaaattctgatatataagtaagtgaattcttacagctaaaagtaacaggacttgggaatacggcttccctaggtattgcttagtcacccagcgacttaagggataggtatcctgtagcattttccttggagcagggtgctggcacacttgattgggaagcttaattctgtaggcagctaacttcaactgtttgataattctctggagccatggccaaaatgaatgacaatctgcaagtgaaaaagatgtgttcgtccttctccatactgtaaatgaaacaggatgttttaaccccactctttgggatttgagaatgttttggctctaccttctgtaaattggaaaggcctatggcttctcttgatagttattttattcttttaatagtacaaggagtttttttttccttgaaccttttgagagtaaggtaaagacatgatgtcctatcaccctaaatacattagtgtattttctcctatagagatgcccccatgagctctaacgtttgcatcgggtcaccatgatgccctgtctgccacccccagtggaatgccaacgttgtgttccaccttgtgccttttggactgaaagactgaggaagagaaagagatctcttaattattgttttagctgtgtctttcattctccctatctctttgactttcttcattgctgtctctgtttctattctgcttcctctttttctccttttgtctttctctgcctctcatttttcacacagcttaacaaagaagttaaaactaaaaactattatcctgtgaggaaaatttgaatttgtagaataaacccacaagggcaatttcacaattgcaaaaaacatcgtcagatcttacgtagactaaaaacatttggtgaatccattcgttgttctaaaatttaaatgaaaggagttgctacagataaaaataattttagtgaagtaaaagtggaaaacaaagttttactgtgaaatacagaaaagcgatgaaggaatgatattattaatattattattttttacggagtctcactctgtcaccaggctggagtgcagtggtgcaatctcggctcactgcaacctctgcctcccaggttcaagtgattctcctgcctcagcctcccgagtagctgggactacaggtgcacaccaccatgcccagctaatttttttatttttagtagagacaggttttcaccatgttagccaggatggtcttgatctcttgaccttgtgatctacccgcctcagcctcccaaagtgctgggattacaggcgtgaaaaatgatattatcttaatagaatttatttactctagaaataagttcttgatgacatttattaacttagtgtgattctggtaaacatttttgtctcaaaaatatcactgtggttaagctgtcattaggaaaaaaacgccaatatggttaaatagtgaatgaatcaaaacatcctgaaccttttgtaaagagtaggggaactgacatttttttttcttttttgagatgaagtctcactctgttgcccaggctggagtgcagtggtgtgatctcagctcaccgcaacctctgcctcctaggttcaagcaattctcctgcctcagcctcctgagtagttgggactacaggctggcaacaccacacccagctaatgtttgtatttttagtagagacggggtttcatcgtgttggccaggctggtctagaactcctgacctcaagcaattcgcccgcctgggccccccagggtgctgggattacaggcgtgagccaccgtgcctagccagaaattgacgcttgaaaaagaggtttagttagtttgtgaaatatgtcattgggaaaatatatttattaatatttgattttgagagagagagagagagagggagaacacaagatgtgattgggttactggcctgaggtatgtgtgctacctcgtactgctgctgcatttgtctttaatatttttccagaaatgatgacatttgagaatccaattactttcgttaagaaggctcagatgacaaaaatctctagagcttgtgattttttaatacatcctttcttagctctttcctccttttcgatgtcaaaacatcaaggacttgtgggacccatgatgggacactgtagaggcagcatctctgacatgacctagtgctggcagtggctgtttatcctgatgctaatcatttagagcatatgctctgatattggatcaaaggatatggccatccttcaagcccttgttaaatattgctagttcatcttgcagagaaacagaatgaattttcagcaccactgggacatgtttcattacaaatgcatatgataatagaaccctgccaaaattaggttttattattatttatttttgttagattttattatatgctctttatttattgtcagcgttttctacacaatgatttgctatttttgtgtcttttttccattgaattatcaagtgaagttgagtacagttgtatatttgtataatttttattgataagctggtttgctatatataaaatttgtttctataattttagctgtaggtgttgtatacatctgtttttgaaagtgttagttgcatcagttcagcaataaataaattctgcgcaccggttactgagcatctatttttctagggcatggaattgaataagaatcattagtccaatgagcttatagtaaaattatgtgtatgtctgtatgtgtatgtgtgtgtgtgtgtgtcccaatataatatgatcattgttatgatagattgacaaagagcaaagtgccgtgggagcacactggagaggcacttagcttaacctggggattcaaggaagaattcctggaagagttgttgcttgagctgggttctcaggaatgataagttaggtgagtgaagatgggaaggacttttgctcccctgtgcaacagctggagtaaagatgaagagataggcacttcagggaagtgatgagaagagacccaatgtgtaggcaataacagtgccaatatactgtgcaaagaactggagtagaaaggaatcaagcccaaaccatggagactactttgttctatgtacaaccagatcaaactttgctgcctgaaggcagagatgtaaagggaaacactcaagccagtgattccaatgaacacagacagtagtatttttatgttattgggtagtcctttattatttgtatgaaataaaagaatccacctaagaaatttgaaaatagaagaaattatgtttttaatttctaattaagctattgaaggtatattccttttgtgaagaaaagtgtgtttttcaataaaatagttcatttgtaactaaaaaaaatgggaactatttcatcttgaaattatgtaggcatctctctttctctctctctttgtatgtatgtttgtacttatgtgtgtatacataaacatctttggaaatatggagcagtattttgcatttattatatgaccttcagtgaggaaattcttgctgaaattttcaacttaattgtaaactttcttaatttaaaagtataaattttacagcaagttagctacttctttgttattttgtcttttccacttttaatttaggtgatacagtagtatatcaatatggagtagctacagtaataattgaagctaatgatgacccaaatggcattttttctctggagcccatagacaaagcagtggaagaaggaaagactaatgcattttggtaagcatatgtagataaggcaagtttaaaattgggtgaaataaaaccattaagtatgtgaaattctgaaatattccttcaaaatttaaaaattggttaagaattgagtaatttcaaagttggcagtctgaatgagtggtaaactttgtttatgctgttgccacttatcttcaaaaaaaaaaatcttttagctagtaagcagaaattattctccccacccccctcgttcaaacttcaatcctttgtgagactgagaaacttgaattattcaagatcttcaggaactcttctctcagatgatatgtgactacccccaccctgtactttgcttttggaaaactttttccaactgtcatttagtattttttgatggagcttagaatttatctttcagtttggattttgaagacaagacttttatgactgtttctcttttattaaagttctaccttattcttctcttcccatgaaattcttcatagtttgcctcgtagaaccagctggtttgtttcttttaagacaatagatagtaaaaatatgtttccttaataacacaggaagctctcattagagtaagattcactacttataaattttctttaatttattttgtaggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtactgtgtttttccatgtcttattttatttccatgtcttatttatactaaattttacattttatacttagataattagagccatatacaaaatgcaattggtgaagtatttgtgtcatgactatctgattttaaatgttaaaatacccttcttgtttcaagtgttattcttaacattcacttttttgatatcttagtttggttcagttttagggatggaggcctacatccatcctcaaacatgcaaatagactttctccacaccaactatagtgtctccaacaagacgttagtggaaggtaggaggtaaggattcatggtagcttaaagcttgatctttgtgtcataatttaagcaatcaattttcgcatcacttttggttttaaaaagcacagaattaaacctttctaattcatatactcttttcaggcttgactgattatcaataaaattatgctgaacaaatattatttcatatcctgcccctaaaatgtggtgaaagccacatggtgacactacttttcattgataatgagtaaattatttaaccagaagtttgtctgctaaacaaattcttttttcttcacattatactagaaagtacttgaaattctagtttctcactcataaattttcttgttacaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtgagggtcatcatcacaactaggacactgaaatttgcagtttctaaaatttttcattaaaatttagatttttaaaaaagtgctaacatgtatttgaaaactctacttatgcattggtttaatttctttaatcaaaactatgtgcctaccaagataatgagaaattctgtcctgagtgttacagaaatgaatcagagaattttgcccttaaagaacctggaataaaccctagcagagagatgtgtgatatatcacaatgacaccctgtaggaagacagaaaaaaatatgaaagaggaatgtttgtccttctgtgggtagtaggagagatggggagtgatattcctgcagaggaatgaacaaaggaatagaaatgtgaaacagcgtgttgcacctggggaactgctgctagttcagtattgctgaaggtagagggtggtgggcgtgaggttgaaaagaaagcaggagagaagaatcacagtgaaaagtgattatagggttcatactatcagcaggtaacttggtgaattctacagagtgctttgaagagatattctttgttgtctttaaactagatcatatgctgattcctcaagaagcacatttgtgtgtgtgtgcacacaaatactggttatatgcattatagtcaccattccctctcagcccctccatcttatgattttattcttttttatatttcgtgaaagatagagtagagcttatatggctatagcttaatagagtattttcctctgaacctcttacattagttatttggttctattttttttcccagagggggaaaaaaagataggcaaaggaaaatgcacgtatctaccaatttcaatcccatggattttggttacaagcactttgtggtattatccactttttggctgtgtgaatacctacaagtatctgttagccttgattcttttggtgatggtagtggtggtggaatgagaatggaaacgattgggggaagtgggagctggtgttttttcctctgacttactgcagaggaacttgttatttttgtactttgtaatttggaaagataatttttaaactatatgtaaagttattgaactgtagtgccctttatattataaaaatataaaagtatgcatattgtaagtgtacagataagtgaaatttttaaaacttaaattcatcagtttcagcactcatgtgatcagcccccagaccaagaaacagcattccagaagccccctttgactcctccagttgctaactcaccaccctgcctactgactattggcatttttaagagcttaagattcacttttcctatttttaaatttatataaatagaactgaacagtatgtacacttgagtgtccagcttcttttgctcagtattgtttgtgaagttcatccatatttttgcctgctgtagatatttcatgctcattaccatatagaattatcttatgtaactgtaacacaatttatttattagtgctactttcaatttctgttttggttgttttctgttctgcctactacatatagtacttctatggatactcttatacatgttttttgatgaacatatgcctgccatatgcatttctgttgagcacattcctggggatggaattgctgaatgacagtgtgtgcaaatattcggttttagtagataatgcctatcctttttccaaaacagttgaacctaattatactctcacctctagtgtatgagagttccacttaattaatgcttagcttcttccatctttacttttggtttgtagtggcatctcacagtatcataaaaggtgtatttaaaaaaaaataatgctgtgttcaatatagaaaaattgtaaagtacacatatacaacaaaaatagaaatcatttacaataaaaatcatttacaatcattataagaatcatttacagtcattcagagatagccactataaacattaagcatactgttaacatgttcgtatacacacactgtatacatatttcacaatttttcttctttattgtcaaaatgatacatgtatattgcatgaaatttgaaaagtatagaatagtattaagatgcagagtgaaagatgccatattccctccatgaaccactgtaacatattggcatttttataacttttattttgaatgatttagcattgtaacttaagtagttaacactacaagtagagaaataatgatcaggtttgtcccagagaattagtcatagaagcaaagtgcttagaatcctcaaatatgtataatgttttacatttataaggcattttccatacattacctaatttgtacttcataataattcaatatattaaatagaggtcagagtcagtaaataaattcgctagcatcacacaggcaagtaacagaggaaccaagacatgaaaataaaccattaactcctaggtcagtattccttttaacataccatagagacagaactaaaggagatgtgatcatttctatatccttgactccagatagcatcctaacagtgagaaccatgatgtggttttgtgagaatcaggggaacttatatcattacagttgccagataattcaataggagagacaacataggatttcccattgaatctggagctccagtgaaaaggtgtttctggtttgctgggcaggaaggtggtctctgtagtcggtatgggagctgtcatgacagtaacatgccagatacttgtgactaccctgaaagacatctgggtggagatttgtgaaacagcctccactgaggttattgacaagaaatattgcttgtacttttttttccagaatctctgccaatatctcatcttgcctaaagatcttacataaatatcttagttgagttattagagtacgaacaggtaaagaaaggagaactagtgaaagcatgaaaaggtttgttattgagatatagtgacacagttgggctacatgttattattatttttaaaagtccccaagacttacatataatgtttctgagaagaaatatttctatttttacatctattctcttagttgtttggatagagagatatatttggcctgtagaaatacttcttatgaattctcacaactttaactcaatgagtgtctaacatatcaagccttgaagttcttaaataataatatagtactgaagtttaaaaattgtgatgaggctaggtgcagtggcccatgcctgtaattgcgcctcaagcgatcctcccatctaagcactttgggaggatcgcttgaggccaggagtttgagaccagcctgggcaacatagcaagaccctgtctctacaaaaaaaacaaaacaacaacaacaaaaaaagccaggcctggcagtggactcctgtagtgatgtccttgctatttgttagtctgaggtggttggattgctcgaacccaggagtttgaggtcacagtgagctattaacatgccattgcactctagcctgggtaaaagagcaagatcttgtctctaaagtacataaataaataaatacataattaaaaattgtgatgaataagtccatttttaaatgtgcaagagtaaattttaaaataccatagaataaatttctatccaaatacgtgcacatacatacatgcatacgtgtgtatgtatgtgtgtgtatgtgtatgttcagatacttttttttctagaaatgttgacagactgatagaagttacttttaagtatatcatctaatttgaagatagttaccaattcttttagtacaaaatataaatcctaatgattatggattccttttttaaaatcataatagaagataatatccaattcattgtatactagttatgcaaaagtttcatttatccaaaaatatctttcagtaaaattgtcttactttctgaatcacacgtaaaatttaggacaggacacttgaaggtattgtagcatttaaacttgtctctaatttcaggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagaggtaagtagtgagcttggagaattttggatttaaaaattcattgtaggtggatttgtttgggactcggctttctttcatttggtaagattggttgcgcatctactccaagtccagaagtatgctagggccagtgattgcaaatataaattacaaaattcttactcttatgagttcaccctttggatcaacttaatgagctgatagaagtaataacaagttagcaaatgaaactttagcaattcgcctgaaagttaatgctcttcaaagaacgtatgtgtatactctacctatttatttttggctactgttttggatgtcattaaattgaatgaaataatatatattgaaggcttgtatgaataattgtatttgcaactttattaaaatatgattttttgatttttttttttttacatgtgaaacgtacttgagtagttagttatcactttcttccatgttgggtgtaaatacctttcttatcaaccttcttggccagcttaattcattaggctgtcttactgtccttatcagttctttccatgttttcaaagattcgtaatcatcttggtttcctgttcagtaatgtgagaactcatgaaactacttcccaggtgttctgtgtgacagcaacagcttggtgaccatgaaaggatgccaaggaacaagagtctttctttttgcaagttgattctaattggtttagaaggatgtataagtaaattgaaatgattttttaaaaatggatgagtagagtttgaaaaaaaatctaggtcataggctcattctagcttaaactgggatgtctgcctctctggagtgtctttcttgccactttagccctttggtttggtggcagtcttaagagatcttcaaatagtatggtcctttttttacatcagaaatagcatatcctagactagcaataacaaatgtcatacaaatctacaacttgaaaagaaagatgtttacatatagtggataatacctttaaataggtattcagctatcaaagaacttctacatattacattttatgcacctttctgataatccataatataggtgcgttattaaccagtgtgatagtgatattaaccagtgtgatagtgacattaaccagtgtgattattttgtataatatgtgtcaacattttgaagatctgtataactcagtaactagtatttttcaagtaatcaatgcatattgttgcaaatcatgcctgggtaaaagactgttccaaagtacaaggtagaccagtagattttaaagtactagagtatgtttccaggttgcagctaaatgctaagaaactgccacttgtcaaattttggattttggtataatgtcaaggaaaaatacccataattatctgaaaagactagtaaaatcctcttcctttttctgttacacacatgtatatataaggctggattttctttatacactttaaccaaagtaaaagatagaaacaggccgggcgcggtggctcacgcctgtaatcccagcacttcgggatgctgaggcgggcggatcatgaggtcagaagatcgagaccatcctggctaacatggtgaaaccccgtctctactaaaaatacaaaaaattagccgggtgtggtggtgggcacctgtagtgccagctactcgtgaagctgaggcaggagaatggtgtgaacccaggaggcagagcttgcagtgagccgagatggtgccactgcactccagcgtgggtgacacaagactctgtctcagagaaaaaaaaaaagaaaaagaaaaagaaacagacaaattgattgcaagaggagctaggagaatccagctgtcttctattaagccagacattaaggagacttttaaaaatataaaataatacccccttatcactaattttttttcgagaactgtagttatttctcataaaatatgttgtttatgttagcatgtaatgggtttattattgctgtcttaaaatgagttatcaatatttaaatttttaatttttcatttgaatatggaaaatatcagcagattttaatgatatcaacaaaaactctctggggttctcaatagttttgatgtgtacaggggtcctgaaactaaaacatttgagaactgctggtttagtctgtgcttgtaattatcttctgagttcaaattttatgatcacttgcttcatttttagaaataaagactacagccacttccatagattcttctccattatgttgttgcaatgacattgacaatttaacgttaaaaaaaattccctcaaaatttctgaatgcaatagagaccctataaagactctgggctgggcacagtggctcacgcctgtaattccagcactttgggaagctgaggtgggaggatctcttgagcctaggagtttgagaacagcctaggcaacatagtgagacccccttgtctattttaaattgaaataaaaattaaaaaaatttaaaataggccttctgagttatgttatgcttttacctttttcatagattaatatgacataaagtaatattaaggttaaaatgatagcataatgacatcttaaacagataatgaaaatatgtagactctgacatagcctgctatttggcacattgaaagagaaggtaattattctgtgatttgttttctaccaaccaggtacactatgtcccggcaaagagcaggtgcttaataaactataattgaaagaatgaataaaacctgtgaagcagtttagggtcctggtgaggcatgccaaatagtgctttggattccaagtgggatctgtattgaacagaagatggattttgttagatctatagcctagtaaccacattctcatgtttcttccccatattttgttgttctgtgtatttcctatgttattttctctgtaccatattttagcactgtttttacgtgtcctgccaaattgtataccacgtaattataaattaatgaagttgctttcatagtgattcatagaacttgctaatcgtattgttttattttttataactaatacttgcattatatgttatatttataaactatggcttaagaatcaattaaagacactttgggaagatcttcatgaaaacaagaatatcatttcaacttggactatatttgtttttaagtgcctaccatgtgctatgtgaatagattccttgggatataagtgatattggtataatccgatatcaccaatcatcacccatgcatgaaacaaaattaaaaattaattggatttgtagctttaattttctattgcaatagagaaggccaattcatggttcagaatactgcattattttttctaagaaaataggtttcaaaaactcgtcttactatttctgtttattattactgttctgatgatctgaatatttggcaaattcctgacttaaaagaggagacggtagtgagtattattgtgtctagtgagaaactgtttggggatggtttgatgattattatggatgttaggccccttcatatactggcctaaatgtttgtttgtatcataattctaaactcaattagatgaatattttaatattagaaaaaaggtttagatatttattttctatgtcttatgcatttctgtattaataattacataccggagtctagtatttctgaaagtgttgcccttggatgaccttgtcagaaatatctaatgcttattactggacattattcctgactcaggaccccattcctggatcacaatctctggctaggggagaggggaagtttaagctgaattagaaaacctttttaaatgaaagttttcatatatagagtatacacaaaaatagagaagataaaggaatgagtcacagtgtactagcttcaataattatcagccttttggcaatattgtttaatcatttttggttaaacaacttttttttttttttttttttgagacggagtcacgctctgtcgcccacccaggctggagtgcagtgatgcgatcatggctcactgcaagctccacctcccgggttcacgccattctcctgcctcagcctcccgagtagctgggactacaggcgcccaccaccatgcccggctaattttttgtatttttagcagagacggggtttcactgtgttagccaggatggtctcgatctcctgacctcgtgatccacctacctcagcctcccaaagtgctgggattacaggtgtaagccaccgtgcccagccagttaaagtactttttaaagcaaacctcaggcgttatgttatttctctgtaaattcagaagtattaaaggtggatttgcactgagaatcctggtagttttttttttctttttttcttttttttcttttattattatactttaagttttagggtacatgagcacattgtgcaggttagttacatatgtatacgtgtgccatgctggtgctctgcacccactaactcgtcatctagcattaggtatatctcccaatgctatcccttccccctccccccaccacacaacagtccccagagtgtgatgttccccttcctgtgtccatatgatctcattgttcagttcccacctatgagtgagaatatgtggtgtttggttttttgttcttgcgatactttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctgtttctccacatcctctccagcacctgttgtttcctgactttttaatgattgccattctaactggtgtgagatggtatcttattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattgtctcccattttgtaggttgcctgttcactctgatggtagtttcttttgctgtgcagaagctcttgagtttaattaggtcccatttgtcaattttgtcttttgttgccattgcttttggtgttttagacatgaagtccttgcccatgcctgtgtcctgaatggtaatgcctaggttttcttcaagggtttttatggttttaggtctaatgtttaagtctttaatccatcttgaattgatttttgtataaggtgtaaggaagggatccagtttcagctttctacatatggctagccaattttcccagcaccatttattaaatagggaatcctttccccattgcttgtttttctcaagtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttgttttggcttaggattgccttggcgatgcgggctcttttttggttccatatgaactttaaagcagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcctttgtaagttggattcctaggtattttattctctttgaagcaattgtgaatgggagttcactcatgatttggctctctgtttgcctgttgttggtgtataagaatgcttgagatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccgtttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaatgttgtcaaaggccttttctgtatctattgagataatcatgtggtttttgtctttggctctgtttatatgctggattacatttattaatttgcgtatattgaaccagcttgcatcccagggatgaagcccacttgatcatggtagataagctttttgatgtgctgctggattcggtttgccagtattttattgaggatttttgcatcagtgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccgtttggtcctggactctttttggttggtaaactattgattattgccacaatttcagaacctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatattccctttatcattttttattccgtctatttgattcttctctctttttttctttattagtcttgctagcggtctatttattttgtcgatcctttcaaaaaaccagctcctggattcattaattttttgaagggttttttgtgtctctatttccttcagttctgctctgattttagttatttcttgccttctgcttgcttttgaatgtgtttgctcttgcttttctagtccttttaattgtgatgttagggtgtcaattttggatctttcctgctttctcttgtgggcatttagtgctataaatttccctctacacactgctttgaatgcgtcccagagattctggtatgttgtgtcttcgttcttgttggtttcaaagaacatctttatttctgccttcatttcgttatgtatccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtacgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcattcaggacttgctttttgaatgtgggtgctcctttgttgggtgcatatatatttaggctagttagctcttcttgttgaattgatccctttaccattatgtaatggccttctttgtctcttttgatctttgttggtttaaagtgtgttttatcagagagtaggattgcaacacctgcctttttttgttttccatttgcttggtagattttcctcaatctttttattttgagcctatgtgtgtctctgcacgtgagatgggtttcctgaatacagcacactgatgggtcttgactatccaatttgccagtctgtgtcttttaattggagcatttagtccatttacatttaaagttagtattgttatgtgtgaatttgatcctgtcattatgatgttagcgggttattttgcttgttagttgatgcagtttcttcctagtctcgatggtctttacattttggcatgattttgcagcggctggtaccggttgttcctttccatgtttagcgcttccttcaggagctcttttaggacaggcctggtggtgacaaaatctctcagcatttgcttttctgtaaagtattttatttctccttcacttatgaagcttagtttggctggatatgaaattctgggttgaaaattcttttctttaagaatgttgaatattggcccccactctcttctggcttgtagggtttctgccaagagatccgttgttagtctgatgggcttccctttgagggtaacccgacctttctctctagctgcccttaatattttttccttcatttcaactttggtgaaactgacaattatgtgtcttggagttgctcttctcgaggagtatctttgtggcgttctctgtatttcctgaatctgaacgttggcctgccttgctagattggggaagttctcctggataatatcctgcagagtgttttccaacttgcttccattctccccatcactttcaggtagaccaatcagacgtagatttggtcttttcacatagtcccatatttcttggaggctttgctcatttctttttattcttttttctctaaacttcccttctcgcttcatttcattcatttcatcttccatcgctgataccttttcttccagttgattgcatcagctcctgaggcttctgcattcttcacgtagttctcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctggtgaaagtcattctccatccagctttgttccgttgctggtgaggaactgcgttcctttggaggaggagaggcgctctgctttttagagtttccagtttttctgttctgttttttccccatctttgtggtttatctactgttggtctttgatgatggtgatgtacagatgggtttttggtgtggatgtcctttctgtttgttagttttccttctaacagacaggaccctcagctgcagggctgttggagtaccctgccgtgtgaggtgtcagtgtgcccctgttggggggtgcctcccagttaggctgctcgggggtcaggggtcaggcacccacttgaggaggcagtctgcccgttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtctgagcttccaggctgctttgtttacctaagcaagcctgggcaatggcgggcgcccctcccccagcctcgctgccgccttgcagtttgatctcagactgctgtgctagcaatcagcgagactccatgggtgtaggaccctctgagccaggtgcggggtataatctcgtggtgcgccgttttttaagcccgtcggaaaagtgcagtattctggtgggagtgacccgattttccaggtgccgtccgtcacccctttctttgactaggaaagggaactccctgaccccttgcgcttcccgagtgaggcaatgcctcaccctgcttcggctcccgcatggtgcgcgcacccactgacctgcgcccactgtctggcactccctagtgagatgaacctggtacctctgatggaaatgcagaaatcacccgtcttctgcgttgctcatgctgggagctgtagaccagagctgttcctattcgtccatcttggctcctccccctggtagttttttttaatggacgcttgacattcgaaagctcttttagaacttaaaaaatttactttattgtacaaaatattcattaaattttctataaagtgttgatatatagcgtgtaactgtacattcttttattagatatgaatagtgatttttttaaactgaaaatattcaggaagctataggttttgatgaaggttttagtaaataaaaatatagttaggtaacttttccctgtgacttttgcaaacaaaatcctcatcttagtcctaaatgctatgtgctaatgcttactgacttgataaaaatttaagtttgtaaaagaaaccattatacatttcttagtgtctctttggatctatttaactaatgcctcttgctgaaaagggaaaagattttatatttacatattaagattaatggtttattaatttaactcatgagatgttacgatccccattttcagaggagactgtgaatgcttgataagtggtagaatgaggaagctcaggactgcttggccttaaagccatactctttccaccacacatttgctcatgtaccattcggctagcatgaaaatcctgatgtagatccctaagtggaaattaaatctgatgttgtattgacacctgggtctcaagctgcattctcctcttctgtccaacatcttaaggttggagtgccctaccttcaggacagtcagttccgccatgacatgatggatggattcttaaaaatcatcacactatgccagatgcataatgagaaacacagaacttatggaaaagatggggttaggaaaacactgctcaaggacttggtcgttgacacttaaaaaaaatagagacctgataaaaatgttgtacacattaaatatttaatacttataaaccacaatagatatggcatattatctttaaaaaactttaagtttacttgtagaagtgggcatcagaaggattgcagcttgtgtgttattgtgaaatgatagaatgagcattatctaaaattggaggaaaattataacactagatgtggttaagtgtggctagtaacacaggtgttgaactgagtagctggtagttgtttgaggtatgtgtttgaggtatgtggcttgtttcacgtgggtacaattttctgtgttcaccaagtttcttgtggatgaaatagcacttataagcaaatgcaagttgaggctgtattcaaattgttccccaatatattatcaattgcattggaacaatttcatgatttcaaaataagtgttatagcagaattaaatgtacttggtcctcttctcctctccatctacactccccctgctgtcgcaactggttttcgaataccatttgtataattatatatttatccaccaattttacatggctttaaatatcatttatatattgataacttccaaatttatgatgtcaatctcatcttttctctaaaattccagactcatttctttagttacaacttgatgcatttctaggatatttatttcatagacacttcaaactaggcatattttaagccctttgattcttacccaaaacctgtgactgatacaggaggaaagtcaaacctgcttcagagatgcctgggcttcatatgttgctacttgctgtaagtgggctgatgcttctctagtgccctaatcagaggtgtttctgaaggtcagagggcagagctgtaaactgtccacttagccatttatcttttgtggatggagaaatggcctgaagtatgaagctactgcttcaaccctgagcagtgcttatggtgtagttgatcggtgaggggcttggaagaatcaagactagagacaaagatgtttggggagaagtcatgtgaatagattgccaggagttaacactgagtatgagggggtgtttcccaaaaggttctcaacaaccgtgaaatcagagtgaggctctgttgcatatcggccagactctcctttgtcaccacagtgccattaacagcatgatggtagggatggaggttatgcataggtttgacagcatgagctccctcttaccaagactgatgtagcaactggtggttgctgaatgtccaaacagcaagcagcagagaccaaagctaagtacttctcaataaaccatttactggtacactgatcccaaccagactttatcactccaaaggaaacagcaattcattcttattggaattaatactttggctaatgtatttactttagcctcctaatacatcctaatacaagcaccatcatctgaaggcataaagaatgccagctttaaccacatggagacccgcatcacacggcctcaaagggactaatatgaaggaggtgtagcaatgggtacgtagtgataggactgattcactggcctcaccatataccatgtcacctcaagtagctggcctcatacaatttaatggcctgttgaagacccaggcacagtgctggcttaaggacagcttcttggaaggttgaagtattgtccatcaggatgcagtgtgtgcattcaatggctggtatctgtttctgtgtccccaataactagaatgcagaggctcaggcagcaggaggtaaaagtgagactgacccctgtctctgctacttttagtgacctactgcctgaatttgtttcctactttagactccactggattagaaattctggttctggcagtggggctgggggaagaatgtgcctgctaggagacaactgagggccccactgacctatcacctggttgttttgggcctctcatgcccatggaccagcaggcaaataaaagagttagaatgttgcccctggtgtactcgatcctctttaccatgagaacacccaggttgctgctgctcagtgaaactcagaggatttgctggaacatctggtgactccacactcattgataactttcgactattgtcggtttgtagacaaatcccaaatctgtcctctccaaaatgtcagcaccaaaatggctctatcttatcctgatcagagatgcttatggttcatatgaaaaatacagatggcattttatatattaaaacttgtatttttatctgtattcatttttggttcttttttctccaaactatatatttgctaacataaaaataaaattgaattgagagactgaggatttgacagtaggaaggccttactctaaatgatattccagctgcttccaccatagagttttaaagcattatcttaaagtgtttagataaaaaattttccacttgaaaaaaatacctctaggtttatatgataaaaacaccaacaaatatattaagcatggtataagatgccctctttgatctgactgttgttcccacactaggcatctctcaaggatctccccatttggcacttcatgccaccccgccaaaatgataccaccaaatatactatattgcttcttatgtctgtgcctagaaagttctctctgatgtcatgttccaccctctaccccaacccccaccccatttggtctgtctgtgctgagcccattataaaattgcaagtttgtctttctctttagaattctacttatccagagaaaggactatgcattaaaaactattttgcaaccatagcatatggcacagtggttggaacacaggaggtatcaatgaatgaattacttgtgcagttaagacattataattctttttgctttatttatctctataatggaatgggagaaaatgaatgattgtaaatatttcttagcagtcaaagtttatctgggggaatgcagaggcctcgttagtcccttttagagaggtagaaagttgtagaattaagtttatggtaaaaggatttcatggaagcattgtaattttgtcactgatttgaattgctatgcacctattaataatttacattcaatttcagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggtaaaccctaccttttttgttcctttgaaagcctcctggaaagcttttcctgaagtgtttgttctgtaatttctttgcagcttttgattgaagtgtcgcttcccattattatttacaactgtaactgatacattagaatttgcttcaaacatgtctgctgtaaaacctttatcaggtagagttagtttcttcatcactttattttgtacagaactttatcatgacatttttgcgttggattttaagtgatttcctatggatctgtctcctatgatagattgggactggggccatgtctaaccccagcatactgcatatgtcaaaacatgtttgtttaattaataagaaaggagaaattgttttttcactttaaattttgaattaaattttgtagagcatggctcagttattcctattccttttataactttttttggattaattgcttgtgctggactcctaaggcccattatgaatctattttctaaaatactgttcctgagcacgtcaggctctccttaggcagacgctagccacagatacattgcccttgcttcttatcctatcacatctcatcatagaacatgcagtttcttaattgggaagtctctacctgttgttggtaataccacggtctttggtacaaaaaatatatgatattatattgataaatcaacgtatcatatatgatgtaatactgatgcatgtataggctactgtcagaaaatgctactgctcagcacctgccttagtctgttgggactgctataacaacataccttacactgggtaacttataaacaacagaaagttattgctcgcagttttggaggctgggacgtctgagagcagggtgcctgtagattctgtgtctggtgagggcttactctgcttcaaagatatggtgccttctcaatatgccctcctcacggtggaaggggcaaacaaactccctcaacactaattccattcatgagggctctatcctcaagccctcatcacctcctgaaaaccccatcttttaataccatcactttggggattagattttaacataggaatttgggggacaggaggataagacattcagactatagcagcatccattatttttaaggaattaatctattcagacttctctttctctttatatgtctatatacacacatatgcacacacacatacaatgttttaatgttttaatttatgcagaaataagtcgtaagtggtaacttcatttaaatataatttagttgccttttgaattttcttctagtaagtaatttctaaatgcctcattgcttagtgcctctggatatttatatttttaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggtaacctgctccttttgcaagaaaaatcctctcttctctgggtgtacttagttttgttaagaacttcttaaggcactttttgcaaatgacggaagtagaatgccttcagacctcctaatttctaaactctttaacttgtatgctactgttttgagagacattgtttatgagagaaaatataaagatcagtttccaaacttcaataatatgttttgaaaagtttttgcaggattatttaaaatggaacaaagtatttctgttcatagctatcaaatttctttaatttaataattatcctatggtgatttgttaacacctaagtaattgaaatactttgtaatttatattttattaagcttcaagaagtgaagctatcactctatattaatttctttttgtcttatgcttaatagtgacaattttctcgattggggaactatcacagatgtctgtcctagtaaattgagaatgttttctgtattggaaaataatatttcttctatgggaatgaatcaagaacatctgttaaaaggtttgggtagaaatcttgagaggcttttcacctttagttttcatagttaggttttgtttgtttgttgatttgtttatttttaagtgttgcaactcctttaaggtgccatttaacctgttctactatatgttctagaatgatttctggagagtctaaaaaaatatgagtaaaagttagaaaatatgtattttaaaactgtatcagtattcctgctattgatgctgctgtgggaagaaaagctttctttgagtaaagacttggaaaattaacaatttaactttcattattctgaaagcttatgaacatattctgtatcaaaagcatgttagttaaatctttgctaaaatattttctaaataaagtccctcagaattttggcctggtgatcaaaataattgtgtaagatcgctttaattgaataagaaattcttgcacagttcattgggacaatgccctggcccctttgtctccactaggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccaggtaatttactcagtccttttgaagttgtatttgcacttgtaaaacagacataatccttctctggaagggatatacactgtacctggaacatagtgactcacgcctgtaatcctagcactttgggaggcaaaggcgagaggattgcttgaggccaccagcatgggcaacgtcgcaagtcactttctctacaaaaaaagaaaaaacagattagctgggtgtggtggtgcagctactctggatgctgaggcaggaggattgcttgagcctacgagttcaaggctatagtgagctatgatcccaccactgcactccagccttggtgacattgtgagactctgtctctaaaataaaaaaagaaaaaagaaaaataaaaaaagaaaagaaaagaaagaaagaaaaaagaaataatctactttatctaattaattggagaatatttatttagaatttacattgaacattattcatacacactgaagtgttttcaatgttgtattttacttgtcttcttagcatttataataatttgggatataacaaacattctgattttacaaatttgtgtacagaatgattgtaatctattcatatacagaatgattgtaatctaatggatcagtcttttatatttcagaatgttgctggcacattagaatttcaaccaggagaaagatataaatacattttcataaacatcactgataattctattcctgaactggaaaaatcttttaaagttgagttgttaaacttggaaggaggaggtaaggctggtgattcaaaaatgttaaatatttgcttgtctacccatgctgatgaaagtagattcctttagggaagtaagttcctttgaattaatcttacttaaataaatgaataaattattagtttttgaagagagcagcctgaaagttaataattgcttaagatacatgataatatataccataatatatgtggtaatataatctatatcaatcatttttgattgataatccctttcttggtaaaaagaaaattttcctctttacataaacttttagaattagttttagaaattaatattcaactcatagtttcacattgatatgctttcgctatgaggtttggttaattctgagtaatatctctgtttattatatggacagcatgttcgtgctatttttcccccttattattacccactgatatttttctagaagagacgtgcttttagagtgaaaagtataagtgtactaagtcaccaaattacagttttcattcatggtaggttcccctaaggtcacctctctcttttctgttttttgctgtagctctgctagatctatctacagatataacgctgtaaaatctggtccttttggatgatctataatgagttgattattaataaaagaagtcaacaataccttaacttcagttctgctattcagaaagctctgattatcaagggttattggagtcaaacttatttcatgacagaactcatctgcgctaagtgaggctattgataatatgtatcccaattagatggaatactttgcaaaagtgttaatgtgtttatcaggtgctactgggagtgttatggaatacatacgatatgcattgttaattacctttataagtttgagaaattgagagatgatatggtgtttatcaggacagtccctttcattacaaaacccggtatcattacctcattattattatttattattttgatgaagaaagccatagtacataagccatccaaaggaaaaattggtaggactgagatacgaaaattgtctttatgtataaaatagataatttgggtaaatatgcaaaaatttttctttcctgtgttcccaaatctcaggtaagagcaaggagaccaagccagtgtttgggagcagggaagtggttaaacagtgctgagcttggttgaatgcataaaacagtagaaatgtgctgtctagtaggtggcatataaaaataccagcttttcttgtcttccagagacaagtccttgtatctccaaatcactatttgcattactaaaaaggttactataaaatatttgaaaagttgccctttgtgtcacttaaagctaaaaatccttatgtaatagaaagagaaaatgttagtgaccatgagctaatactgattaataattgtacatgaaatgttattgagatgataataatacttgtgatcatatgaccacttatagtgacacttgttatattattgagaaacttctccccatatctctagaatatgcattgttatatattaattggacttgaatactcactagaaaaccaaccttgcagttgcgtaggaagcaatagtggccgagaatctgatttatccctccgtgagttgggattggaggaaaaggaatttatacaatgacctctactcctggactcatatgtagggactgtctaacatgtcaagtagcttatagagcttaattctttggagagtcaaggacttatttcatgctttttgactataaaactgatgaaactgatgattctacataaggtagccacaacctgaatagatgtcttacgctagccaaagtatatatggtgttgaacttcttttttatgacttctggataatgtgggagcaaagccatgtaccagatatttgctgcaaatccattttgccttttggatctgtatgatgatttcaggttctgggtgccatacattctcatgtctggtatattcccatcctattgacaggcaaaaacacagggcaaaaggagaagagagggcagatcttacactagcatgtcaatcaaggatattggtagaagcgtatacgtatggatgtggctttgctatttttactctcctttttttctattgctgtcatcactgcccttcctatcttctttgtttgcaaacatttggtaaaataatggttggggtacaagatgtattagagggaaaggtataaccactttctctttattattgccaaagtactttatattttatattttgatgatattatttattttccattattttatttgatctttataactcttagtccatttcgtgctgctataacagaataccacatactgggcaatttataagcaatagaagtttatgtggctcatggttctcgaggctggaaagtccaagactgggggactgcatcttttagggcattctagatacataataacgtagtggaaggctccacatggtcagagaatgcatgtgagagggcaagagagggctgaacttgcttttacaagaaacccattcttgcaataatgaacccactcccaggataacaacattaatttattcatgagggcagaggtgtcatgacctgatcaccccttacaggtcccaattctcaacacggttgcatttgcgattaaatttcccacatgtgaactttggggaacacattcaacccatagcaacaacatttctataataaaagacagcatctttcataggtgaggaaactgagataccaagaagtttagtgacttgctgaaatttttacagctggcatctttcacaaccaggaaagcagaattgttaggtgacttgtctaggactctttccacaatgccagtggccagagggtgatcaagtttgagaatggtaaataaatgtggtggggatttgaatgtgtggatggaaggaaaggttagatgcatttctcaatattgaactggttgttgtgaatggtaaggtgattatcacaggcatattaggcctaagtgtatgattatataatcagataaatatattttaaatatctaagatattagaaaataatttacgttggtgtaaaaaaatgaaaatttaaaaataatactagattgacagaattgggaagtaacagttacagtctacatggagtatttcatgaaactgaatgaaattttgataatttggtagcttgactggtgctataattctactatttaaaatgatccatttcttatggaagaatgcatgttattgggtgaatattactgcattttcctctttgcttgatatgttttaagacctctcaattttctcattgtgtcaatgtgtgttgtgtgggttgtgtctctgtgtctccttgtgaagtagctgaactctttagggttgatggaagtggtagtggtgatggggacatggaattcttccttccaactattcacaaacgtggtaagcagtttttccaaggtcctttactattataggtttttattttaacttctcattttagagacaatactaaccacttattgacacctactatgtgtaggtcctttacatattttatcttattaactgtcacagaaactttatgaagtatgatttccttcatgttgtagtcacccagctagtaagggatcaagtcagaatcacatccctttctgcttccaaaacccagactctccttcttgtatgaacctaatgtagtttcctgattctaattgtgatagaaatttcacttgaatgtcatttataaaaatggttgtttggaaacattttacatagctttgaatacataaaaagaggtcaatagaaaatttgtattttcgttttaaatacatcacacttattctctgtacaaaaaagaactatgaatccttatatgtaaaatgtaatcaaaacaaatggggagtaatcccagcactctgggagaccgaggcgggctgatcacctgagctcaggagttccagaccagcctgaccaacatagtaaaaccccgtttctactaaaaatacaaaaattagccaagcgtggtggcatgtgcctgtaataccagctattcaggaggctgaggcaagagcccaggaggctcttgaacccaggaggcggaggttgagtgaaccaagattgcgtcactgcactccagactgggtgacagagcaagactctgtatcaaagaaaaaaaaaaaagaaagaaacaaatgggaaaaataaataaggaagaaaataaatggaaggatagttggcaattattgaaggtgatattgaaaagaggatgccttttgaagtagatttatatacaaacatgattcagctttttacctcaaatatttttttcatatatgaaaagcatacttagaatatttgtttcttgaagaagagcattttctaatcctcaaatccttcttttttcacaatgtcagattttatattttagtgtcagaactcatgatttcactgccttcattcctaacttccatcagtgcctaatgcaacctctgtagttaattacactattacttttagaattgttcattttctagtctgtagacattaatgcaacataaaatttgaacatactttttaggaaaaacttaaatgctgctttagatcatggcatctttttagctacagaatgggactatttaagatcaggagagatagatttatagtatcatcacatgatgaaaaaataggcctaggattcatgcacgttggaaaccaagaatctgttccgccagaatgggaaactacttattatttcatgaaggtaagagtcattttggctcaagttcttttgaggtcagaaaggtcgtgggagaccttcctcatatactctgtgtggaagaatgttctctttcatagagaagaaaaagaaaaacaagttttccttattcatctccaagtgcttatgcagcacttgtacatcacgttggtgccaaagtagagaaaggtcataaaagcatgaatatgtgtggcacccatttgtgtctgcctttctttctaaaacaaattagaatgtactcaatgaatggaaggactcttttcaaaaagttgttccttggctttttctttgatttgtaaattactgatcatcattttttttttctatttgttggaacttgttcatgcagccagtctaggagtggcttcccaaattctagtgacaattgcagcctctgaccacgctcatggcgtatttgaatttagccctgagtcactctttgtcagtggaactgaaccagaagatgggtatagcactgttacattaaatgtgagtaccttttcttccttcattcctagacactttctgttgttttaaaaactgtactgtgctatgaaagtgtgttttatgctttcctttttttgtgtaggctgaggggaatgagcctattggcacaggcaatacaaattggtgatcaaacagtcgtttggcatttatttttgtctttagtattgcacatggagtcattgtttaattctgaagatccttgaccctttaaggaacataatggagctgtactacaagtatttatcttacatagatttttgtgtttgttcagataggctgtggtaacaaacatctctaaaatatcaatggctagtacaacaaagaattgccttcctccctccctccctccctcactccgtccctccctcccttccttctttccttccttccttcctttctttctttcttttttcgagacggagtttcgctcttgttgcccagtggagtgcaatggcgtgatctcagctcaccacaacctccgcctcctgggttcaagcgattctcctgcttcagccttccaagtagctgggattacaggcatgcaccaccacgcccggctaattttgtatttttagtagagacggggtttctccatgttggtcagtctggtctcaaactcccaacctcaggtgatccacccgccttggcctctcaaagtgctggaaaagatttgtttttcattcgtagtatgtatatgtccaacttaagttagcaaggggctctgattattagtcactttaggcaccaaggctatatctcagcaggtgcttttatcttcttggcggagggaaatgtggatgtgaagaacagcataccagctcttatagcttctttctggaagtgatttacatcatttctacttaacttccttgatcaaagcaggtctcctggctgtgcctaatgtcagtgggtgaagtgcaatcctatcctgtctctctcccataaggaaagaaaatctaaaacatgggtgaactggcaataacaataactctatatgatgtgtgtgtttgtgtacctactctgctttgttccagtagaaattaggaaggattcattgttcagtgactcacaggagctagctgcttgctcagcttccatacgaataatgaagaaatatcactcaaacatatccttctgtactattatggcagattttcaataaactgttgtgcgataaattcaacaccttagaaaggataactaatgactcaggaaagataaaaaaagcgttaagggaaaggatcaacttttataaaattactgtctctaaattttattttgatgtaaccatcatatttcaagaataaataaaaattactcttagttgggatttacttggagaaatttttaaacttttcattcttaacatattattgacaaaagcatatcttccttcttaaatgtattttcttatactttgggtcaaatatgttttttgatgagtttgtttacataaaatattgaagataaaagtaaatgtgatttgttttaaaatgagttttacagatcacttttcagaaaaacaccatttatacattccttgcaatgaaatatataccatttttgcagtgagtgtgaaaattttatgagtgtgcctgaatgtaatatgttgttaatcacatttaatttattgggcataaaagatacacaaaaaatagttataatttaaatagaagctacgtttttttcatcaatttatagtttcatgcaacaatcgcctttgaaatttcaattgtgttttatttattttttttaagagatagagtcttggtgtgttgcccaggctggagtgcagtgacaccatcatagctgactgcagcctcgaagtcctgggctccagggacccttctgtctcagtctcctgaataactgggactacaggcatgtgccactgcactcggcatagtcactttttaaatatcctctatttgtaagactctctgtgggccttcaaagatggatagtatatgacccctgcctgcagcagtcttgtagtctggagaagaacttatataaaataaaattgtgctgctatcattaatgtatttataagcctctaagtaactggctttaatctctcttttaatagattttaatattaagtattttgtaggttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaagtaagtatcccttagtgtgttattattattattagctctcagaatcctgaaacaatcagttttaaattttatttaatagaaaattctataaaaagtagtaaactctaactttgaaaatgtcctcttacaacagtttacctgtaaggtaactggaagccagacacatttttttcttagaaattatgttttaaaagtcagtagaaagtaagatgggaactttaaaattatctagcacactctattataacaaggttggtgtagtcttgaggctgcctctgatttctggatgagtggattcatccactggggttgctgtaacaaactgccataaactgggtggcttagaaacaacagacatttttcctcatagttctggaggctgggaagtgccacgattaaggtgccagcagattcagtgcctggtgagggtctgcttcctgggccttgtggagggttgaggggtctctgtctctctcaggcctcttttacatggggactaaccccatttacaagcgtctcacctccttaacctaagggctccacctcttaatactatcaccactgggattaggatttaaatgtatgaattttgaggcaggagaacacaaaccttcagaccatagtaacacagtagttcagtgacagtattaattaagaatgggccgtgcagaacaggtttgtcagggaagaaggcgaagcggttaaagaggcagtaatttagagtatgatgatttgcagctagtttttgaggtcaaggaactaaattagtttcctactcaatcttgtaactgaaatgcagttttgttttaatggcacagtgaactaattagaagagcatcattctgttgtaatattatgtaaagtgatgattaattatactctaatgattttttcctttttgataacttttcaacacatattaaaatatttctgtaggtaactgttcttttgttataaattctataataaaaatttctctagaatgtaagctacactagagcagggacattctgtttagtttatttttgaatcccgaatgtctagattaatgctggtgcatattaaacaatacatattcttaaatattcttaaatataaatagtagggctgggcgcggtggcttatgcctgtaatcctagcactttgggaggccgaggcaggcagattgcctgagctcaggagttcaagaccagcctgggcaacatggtgaaaccccatctctactaaaatataaaagaaattagccgggcatggcagcacgtgcctgtagtcccagctactctggaggctgaggcaggagaattgcttgaactcaggaagcggaggttgtggtgagccaagatggcgccactacactccaacactccagcactccagcctgcgtggtagagagtccatctctataaataaataaataaataaataaataaataaataaataaataaaataaatagtagagggaaaaccccaaatgagaatcctatttggctgatggaatcttgctgaggtttcttgatgacttttggccagttcttagaattttgatagctttctgtgttctgtgtggatcttctgtctttcagttccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtaagaaaagacatctaaaaagcagtacatacagagggatgtaagcacagagggacatgtatccttgattaacacagcctctcaaagttgcaattaggataatcaactagaaaactagaaatactcttgtatctttttcaagggacaaatctagagtctttttttttggggggggggatggagtctcgcttgattttacaatttttttatttttatttttattttattattattatactttaagttttagggtacatgtgcacaacgtgcaggttagttacatatgtatacatgtgccatgctggtgtgctgcacccattaactcatcatttggcattaggtatatctcctaaagctatccctccccgctccccacaccccacaacagtccccagagtgtgatgttcccctttctgtgtccatgtgttctcattgttcacttcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagcctttgctattgtgaatagtgccgcaataaacatacgtgtgcatgtgtctttatagctgcatgatttatagtcctttgggtatatactcagtaatgggatggctgggtcagatggtatttctagttctagatccctgaggaatcgccacgctgacttccacaatggttgaactagtttacagtcccaccaacagtgtaaaagtgttcctatttctccacatcctctccagcacctgttgtttcctgactttttaatggctgccattctaactggtgtgagatggtatctcattgtggttttgatttgcatttctctgacggccagtgatgatgagcatttcttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcgaaaattttctcacattttgtaagttgcctgttcactgtgatggtacttacttttgctgtgcagaagctctttagtttaattagatcccatttgtcaattttggcttttgttgccattgcttttggtgttttagacatgaagtccttgcccatgcctatgtcctgaatggtaatgcctaggctttcttctagggtttttatggttttaggtctaacgtttaagtctttaatccatcttgaattaattgttgtataaggtgtaaggaagggatccagtttcagctttctacatatggctagtcagtttttctgaatgggcaaaaactggaagcattccctttgaaaactggcacaagacagggatgccctctctcaccactcgtattcaacatagtgttggaagttctggccagggcaattaggcaggagaatgacataaagggtattcagttaggaaaagaggaagtcaaattgtccctgtttgcagatgacatgattgtatatctagaaaatcccattgtctcagcgcaaaatctccttaagctgataagcaacttcagcaaagtctcaggatacaaaatcaatgtacagaagtcacaagcactcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaggatacaaacaagtggaagaacattccatgctcatgggtaggaagaatcaatatcgtgaaaatggccatactgctcaaggtaatttatagattcaatgccatccccatcaagctaccaatgacttcacagaattggaaaaaactactttaaagttcatatggaaccaaaaaagagcccgcatcgccgagtcaatcctaagccaaaagaacaaagctggaggcatcacgctacctgacctcaaactatactacaaggctacagtaaccaaaacagcatggtactggtaccaaaacagagatatagatcaatggaacagaacagagccctcagaaataacgccgcatatctacaactatctgatctttgacaaacctgagaaaaacagcaatggggaaaggattccctatttaataaatggtgctgggaaaactggctagccatatgttgattttacaattttgttttgttttgttttgagatggagtcttgctctgtcacccagggtggagtgcagtggtgtgatcttggctcactgcaatgtccgcctcccgggttcaagattctcctgcctcagccttccgggtagctgggactacaagcgtgtgccaccatgcccagctaatttttgtattttttagtagagatgggattttaccatgttggccaggatggtctcgatctcttgacctcatgatccgcccaccttggcctcccaaagtgctggtagagtttttatatatttatggcactgagcttgtagactttgcaaaaagttttggccaaattatctatgaatttgaaagctatgatgaccaaaatatgcacaaatcaatgaaaagtaaactgaggaaaacactggttttctctgagtgtactcctcatttttgaaagggattcacttgtaaatgactactgaggaatgcagggaaaatgggcagctacatgctttcagtgcttggcaacagtcttgtctctggatccctttatcttcttgcttatttatttgtgaagagcaaggaagaggcaacagttagtattaactattttatatataagaaaatgacttcattgccagatgtatatataagaagactgcctactttgatagtgccgtcccagcatccagagggagatttgcctgagaactattcaattcgaatctttctagtgtgctttcagaggaacaggaatgtgaatggatgggatactgtgcttgatttaaaaaaataaatcatctggccataatacttgcttgaaaagacaataaaccaggcccatctaatacctaactggtgtaggctggggtagctcctaggaatacctggctgcctgtagagggcctcacacactgacagatggtggggattggttagtgtactaagacattagtcctcagtcttcacatgaagcacccctcctttccccacccacctttttttttttttttttttttttctctcctgccatcctgagcagtactcagtagcggctttcaatctatgcaagaaagtcttttcatgtccagctgtatcattgatgatgctagcgttcccatatctgtgcagtggtataatttatctttccagtggcattacaattctatttctgttcttttttctaaaagtacacatttttttcttgtagttaagggggcctatcttgtaatgaatgattctctatttatataaatagaccaaatagatatacatctttctgaaagtgaaggaatgaacttgagcacccctaggaagtctttttcgttattttgtgacattatcaaacccatttttctactgagaggcataaaagtcttcttgcttagaataaatgtagtcaatatcctcaaaaaagtatttccaagtagatccataaagtttgttacctgatagtttttccctagtatatggaatgttttgatcatattttagaagtcttaacattttacttttggtcttttcaggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggtatgaagactaatttatgtctctctttgacttgtctgcatgtatagatcatagataatgatctttacttttggagactcagaattgatctgatcatgctttctttcttaacctgctgttactgacatataggacatctgtacacagttattggcagttgttagtgattgtttaaaaaagaaattaaatcaatctcttagcatatgtggagaagtcacgaactattggctttagggtgtgacctggctcctatatgtgttttgtgagtcttaggcaattctttagaaaaataatttaatttatagaaatttacacaaaaatttggatttctgggctttcttgataaataggaaatgtggcaatatcaagttccctttcctgcataacatcagtcatgggaaccaaatagcaactgcccctctggagcaggcttgcactgtgcaatcagcttctgtgctcactggacctgtcactcatgtctggtatagacttgagccctatgggctttgtggtttctacttctatcacagtgaaaaataatttggaaattttggcagagcagaccaatttgtatcacagcatgttactctggtttttgtgggttatagctacttagattgcttaggggggaagagaatccactataggatggtgcttggttaactgttatctctgtttcactttgtatttgaaatgaactctgctctgtctacccttcaggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggtgagaggactggctagtatagaatgacactgtaaatcataccgtatctatagtgactagaacagatggccattgtaacattttggagaggatgtcaaataaattattcctgcaagaatgttcaaactatgctagtgtgaaagtgatccttacagttgacaaaagcaggaatattctagaaatagattgtatacatatgccagtttactactataagacttttttgtacaattaacttgcattgttcaacattttggttaaaaggttaaatacatatatatatatgtatatacacatatatagtcttaatttataatacatttgctctgtataaacttttttctttttttttttttttttgagatggagttttacgcttgtcgcccaggctggagggcagtggcatgatcttggctcactgcaacctatgcttcctgggtttaagggattctcctgcctcagccttccgagtagctgggattacaggcacatgccaccatgcctggctaatttttgtatttttaatagaaacggagtttcacagtgttggctaggctggtctcgaactcctgacctcaggtgatccacctgcctcagcctcccaaagtgctgggattacaagcatgagccaacgtgcccagcctgttctgtataaactcttaacttatatttatactcccttttggcttgggtgtgagccagtcaatcttaagtattattgtggtttttcattcattcattcattcattcacttattcttcaaccattgttgagaacttactatatgaaaaatagcatgcgagatgcatcttcttgatatttccttttcctgatgaagcagcaaggtagcaaatataagtacagtatcagtggaaaagttaatcactaacatacattggctgaagataattttattgtatgaaattcaagtattaacatttagatctcataaaattacttttgatagcatttattctttaatagtataaaattttatacaagttcataaaatttattttgaatgctaattgtgccatttttcacttctaaaatattagatattcattagcacataaaaaacatttctgtttttttctctctaaatttaggtggcattacagtatgtttttgttttaaattttgtcaaataattttatttaagataatgtgggaaataaagcatagtatattaacgctccattaaaatgtatatttcagattttttttaaaaaagttataggacgtaaaagtactattattgaaatggtaaacataaacagggatattaaaattgagtcacatgattatataacaatattaaggagtttaaacagcctgtatgtcttatatataactaggttctgttattaaatgttgatgatgggttattctgttacatgctgggtttgtaagtgtaattggggagttcttttagtccatttatatttcattccattttgttcttgtacttgtatgtatatgtttgatttttttcccttgaatcatttttattctaatttcagaactgtgatgctgttaaggaagttttcactgtatttttaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaaggtatatgagatagctacttgcctctgtgggagtgatgagaattgtggggtggtggggaaggatcccttgcacagttaaatcatttaggttttgtggttttttctatgccataaattattttataggttattttaatgtgttaactgaattatgcttattagtataaagggcctttcatttatcatacctattgttagtgaaatgggtaataaattttacatcactgagctctctaaccccagaaatgcattgctctaatctgtaatttgttacaattagtacttaaatataactggcttttaaattaaagagcatttgtatgatgtatgaaggagctgatttccaggtctgttttttttttctttttttgtgaggcagcattgggctcactgagctccttcagaaatagaaaacaggatcttgggaacttgtgacaagtccctggtatccacagggaattgattgcaggtccttggatataacaaaatccttggatgctcccctttaatataaagtggtgtaaaatataatatttgcatataacctatgcacagtcatccatatactttaaatcatctctagattacttataatacctaatacaatgtaaatgctatataaatagttgctatactggactggtttttaaagtttgtattttttaaatttttttttttctgaatatttttgatctgcggtcttgaatccacagatgtagaacctgtggatagggagggctgactgttactacatttcctcaaaatgtagtcatgtttgttatcattgttactttgtttcagttaagtaaagcaataaaaattaactttgtaattttgttttgaaaccctgaatttgcataccttggaaaatattttcatagcttggttaaaaataagtgttgtttgattgaaaattagcaaggtttcctcacaggagaaaacaaaatgttgggagacaagtgtaattaagaaacaggattgtgtttgtactatgactttaaacatttttttaaaaaactaaagaccacagtcagcattcctcttctctatttgtaattactttgagtgcttaacctgtcttttaattgtcactccacattttagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgagcaatggttctaaatgaatttccgttgccccagtaaagtcatcatagtccatttttatgataaaatttataagaattcttactgtgtacattcttgttaatatacagaaatgtagtttggctttagaaaaaaatagaagttaattggcttgttaatggttgacatgacatacatagactgacatgactgtacatatatatctttttagtttaaaaaatagattttccgggaatatgtgaattttatccctttatgtttgatagtagtgtctttgacaaagcacagaggaaactataaggcaagttctaattttgtaagggaaattttaataatgacccatgtacttacaaccatacatgttggtaagaagcagtggtagctaggaaaatgagtattaattgataaacattttcatatgcactagacaaatcaggaaatatcatcagagaaaattatttgtaagtaaaagtagcataaactttggtgactgcatttatattacattaatcctaatgataaatttataatactgttcctacacttgagatcactattgtaaaatttcataaacaatatactgatattttacatgatcagctaattagaattaggatcagattgagtggttctttttcaggactggttgactcgtgtgctatttaaaattgggaaagttagtatgtttaaaatagttttctctgggtgtgggacaggtatctttattgagattattgattacatcctcatttgggcagttatatattccacaaaattttaaaaaacatagtgcttttctggttgaaaaagtaatgtatactctaaaaacctcaaaatatacaacaaaatgcaggaaagaaactttgttcctaattctatattttagaacaatccattgtatttgttgtttaactttttaaggcatatacttttttttggaaactaattagaggtcatggtacatatgtaatacgctttttgaaacacataataatcattatgttttagagtaaattttaaaaattgtataaaatatttttattatggttattttctagtcagtgatttgaggatttagtgggatatgatatgcttgacggaagatgggaacaggttagtaattggtaacttttctatttcaaaaggaataatgaaaatgtgacgaggagggagtggaaatgaaaatataaagttggatttttccagtggttatgttaactacaaagaaagttatatataaagaaatagcattatataaattaccattaccatgaattataaccttagcatcacacaaaatggactctattgctaacttagattcttagataatgcagactctcttaaagcaatcttgacactgctgtattgatgaaaatgcagcagggtcacaaaagagagaacatgcatttaatctcctttctccttttccctgccttttcttttcccactccttcattgtctctccagaaagtggggagaaaataaataggggacaccttaggctgaatggcagaaagtattggatttagggacattctgtggtgccctatctactagatcaaattgcaaagtagattgcttggacttttgttgctgtcacttgtccctttgagttcctcttttgttttcttccttcattgcactacttcctggagactggtacttgatgctgtcatctcatcgagttactcaaagatgcatctcatttaggctggttcttttgctcagaatttgacatccctttttagttcctcattttgaccacgattccctaagtgttcctggtttttcaggaaggtattgtgttgatatctgattaaaattatcacagtaatgccagaatgagaatgagactccactttcctaaagggagttgtttctaaacaggatatctttggagctcttttcctagctaggtcactgttcttggctaacaaccaggaagtaaagccatgattctttgaaacaattctaccttttaactttcccataattcaaaatgtccttctccacaatctgtcttcattaatgaaattttacagtgtttgatatgtgaaaagatatatatatatataattaaaatttgcttatgttgcccatgatatggaactgttataattcactcatatttttatttaacttttaaacatagaaattattttgggcctttctgagttctctgtgttggtgattttgttactttggtttttattccattgatgtttttataggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggtgggttcctttttttgttaagcatattcattttcttttctatggatgttgtcttttgtctagttctttaaaacttgatagtttttccctttcattattttgttgaactgtgtgtgtgttaatctgcatagaacttctttgggagaaggctttataatgaactgtttagccagatttaggagccttgcaaaccaataccatgttctagcttgccattctctactggtatgattttaaggaagttaaacctgaaatgcttagttttcccatttgttaaatgattcaaaatattacttcataggtttctttgtgaggattaaatgagctaataaaggtaaagtgcttagcatagttcctggcaagtatagcgtatgcccaagggtagctgttggtatcaaacagtgaaacattggtaaccggttaaaaacaagtaatagtttgtaatcagtgaatattttagcctggattttatattgtgtttgtacattttatgaacaaagtgccaaaccttataaaatttctttttttccttaaaaaacagtaattttcttgaattcttacttaatattttacatcatatgtagggttttgcatagatgggctaatttttgtgtgtttaaaacataacagtgtttttgtcttcgagtaagcctgttttggggtaaataggtattggtagcctgtgtttcattacatagtttatctggaattaaaaaaataattttaccttgaatagttaataaatgaaaaggatatagattgtgtacttggacatctatttaatagatgagaaaacaaattgagacatagagagattaaaagacttgacagtgtcagatggttagtggctgtgccagaaacagaatgtattttactgtattaccttttcccttactgtacttccaacttgcaagtttatttatccatgcaaatattcgagccattttcagtactctacttttattaacggtttggaattgcatgttgtcatagcagtaatgagtaaaagtgaataattccataaatctaacctaaagacagatcatcaactatcaaaaagttatttgtaacataatacagagttactgcaggaatagttaataataatgacaacagtaacacttacggagtgttttctgtgtggcagacactccaccttcattatttcacttaagtttaacagcagtcctatgatataggtataattgtatacaccagattttcatacaaggaaactgaatttgagagagactaaatagcaacaattattcagtggtagtgcttatgcccagctgtgtcaaatccaaagcccatgctatatagggcacctagtgaggagagactttgttttgcttgaactcacgtctgctgcagaacctggcaatgcagggacttttggtaaatatttgaagttatttgagttggaagcataatgaatttgagtagcagtgcctgtgtgagggaaggaaattagtgagagaacctgactctgtttcaggttaaagatggacattggttaaagatgatagctgaaatctggaaaatgaatatgatgacttttgtggacagaggaaaaaaaagcaaattatcggaatggaaccatgaagaacatcagactaaggtgctgggaaagaaaaaattacctgagaggagagagaagcctttgctggagaggcagggagaaaccagggagagagtgtgttttcaatcagttacactgattactccgtaatcagtgagtaatcagtaatcagtgtgtctcatactaacatggccaaaaaggggagttagatctcaaatgggccaaataaaacagtggcaatggtagatgaattttaaaggagtattggggataggaagcaaatatctaaggatgacaaacatagaggtcttcaggggttcctcctcaatgtggctttcaggaggctgcctgttcagtgtttgcttctggtctgtgacaagaggattggaaactcttttaacaatttcactttgctgtgatatccaaaagcagtatctatgggctggtattttgtatgtcttttttgtttgcgttagttttttgctatttaacttatctagtcatttattttattctgttttataagagggtcagcctctaatggattaaggcaaacaaaacaaaacacaaatccctgtccttcacagcatgaagttttgagaagcactgcttattggctataacagcaaggagaggagaagcattggatagaacagatgacgggagcattttggatttgttttgttgaagaaatagggggaaggaaaagagaatcaaagtattagtggtatggaaggtacaaacaagagctgagatcaggaaaggatagacgagatttaaggagggacttagagctatactaggcatgcacttttcagcagtgtgatgaaatttcttttctaaggaatacaaaacaatttggatgtctaggatcaatttaatgaattttaactgtagggccactaatgttgtgaaagtgcatcctatgagcctggatggtggtgctagtggtgagttggagggctctgaagacacggaggccctcctgctgggtaccacaacatcttggagaaactgcagatatgaacacctacagtctgtttggcccagatgaacttcacctgaaaacaatattgtagcctcgtcagtttccaacagctaattatctgcaggagaggcaaagaggaaagattattaattaaaataaatggtccaaaggtgttattggttaaaaatctgctttagcatatcaatctaaaacaccaaattgcttttcttgctggcatgagtgctccctagattttttatgttttctacataaaagttggagtcaatttctattttttacttacttttttctcttcattcctaagccttttcctagattataaattatttttttcaaaaacatattaagccacaatagttcagtattttgtgtatgctttatattaccatgaaaattgcacagagaaatgtgtatcatgatgattttatgaaagtgaattaatgaaaacatcatggtgattcttcagagataaccgctaaacaaatggggtgaaaataattgtgccatgtgagcttttaacagtgttaacgttgcttttagcctagtgttggagtttcatttatgtgattagatttaaaatgtggactatgctgaacttctggctctagaatgcatttttgattcatgggaggaattgccttagtctctaacaatgtattgaattctgtagaatcctatttctacattttgtcctaatgcagttggagagctgcccagtggtaaatattactttctttcaaatgtaatggacagaatttagaaatatgggacaatggattttactgtggttgcacactgggtataaatgtgctctttataaatctgtgctaggtgtttctctcagtcacccagctgagcagcagcataatcatcatgtcatgttcgatggattttaaattttttcttctcttagggacagcgtgaatcttttttacacaaagatttgagcaagaaatgtgattctttaaagaaatatatagaaccgctctactggaaacactcaactttttcttaactgttctttttgacagtctgcttcacattattcatattcctataattgttttatcccgttttcttttttgttatagagggcaatttggatagtatatgtatgtcatgtatacacgaatctattaaatatattttctgtattttggttttccattagttttatgtacattgtagttggtgtttatctttgtaaaaagaattctggtcttgaaaataagtgtctaaaacacttaggtttattaaaatgcattcttcattcatattctttatctgcattaggttagtcctagacaccatgtaacagatctgctttagagttgaaatatgtcactaacttttggtaaactctggatttcgtatcaagatgatcgtccagttatgtagtcagacactttgttatgtaagggttgttctgcctttcatcttgggcaaaaactagaaggctgtttagtacctagtaaagtctttgtcatctaaaaataacatactctctcttaagacttttcttctgtcttttcccttaaatttggaaggctaagcacttatttttaagtttttcattttcctgtgactgtttgacttttcatcctggcagaaggtatctttctgatatgtccagtcattttttccaggaggcattttaaatggacctggctcctgggagtctgcaataaagagacagaataaatacctcccttttgattattgcttagaaaaaatttcacactattcttgctgttgacatgatacattttcactaggcttacaagattatgtgtttaagaaatatttcatttatcttttatttatatgtgcttctctatgtgcgtgtgtgtgcgcatgtgtttgtgtatatgtgtgtgtgtatcatacttcaaattatatttttgcagtattttcttgcaagttactttcatagtaactttttaaattttcagaggggatattgatgaactagtattagacttttagtgtttttacatgtagtaagtttgtctgaatattttactttcttttctcctaagcattttatttttacttttacctaaaaatgatgtatttatgcccaaatctctgtgtctaaacttgcaactgcaattttattattgtgattatagattacccttcaacatggaaattttttgacctgcattttgttttcttgccatttgtgttctctttgcactttagtacttcattaaacttccataattttctttttgaaccattaacaaattttgtgatttgaaaagtttgaaaaccatgactcttatgaaagagtcaccagacaacactgtaggtgaaatagcttaataacttcaaagatttttctatgctttttagtaataaatttttgtttttcaatattccaaacttgctctataagaaattctatatattgtacaatagagagacaccagagtttcacagtagtgtctatattttgttcacaagttttacaaatacaaaatttttaaatggtatgctagcaatggctgactatacatagtccttcattttcatcccaatctttggacaatctgatctagaaattcctgtgcttttaaaagataaaactaagacatagtctactaatgtaaaggtaactaattttttttgtattgacacacttaaaatgtgttttaagaagcctttctaatgcttttgtttatattatccactctccttaaaatgttcattttgttaaaattgtgtttaaatttagtatgaaaaattattttgtttttaaattgaaattaagatggtctctaaattaattaattcatgatattttaagaaatcttcctataagaaatatttgtttagttgtcttcagaaataaaaaatgtggcggtttaaaaaatacttgaaaatagtgtttaaagtttattgctttatttctactttttaaaaaatgtttgaagatattacttatatacacaaaagttacttggatagctaactgaactaaaactaactaaaagtgacatttttagtgaatgtttgtggtttttaactatatgtctatgctatacagtttgattaaggatgtcgtcttctaaatctttttaaacatcattctatccttgcataataataattttttagtgatacagttcattggtatttcttagttgtgttcatcatcatataaagctagtgaattgagcatattttcaacaagtcatatggccattagcacgctccctaacagcttactttatgcttttagcaatttgaaagacatgttatgattttcttcacttttgtgaagtattatatggggaaaaaagccaggaatagaagagatctaaaatatctccattatccaggaaggataactgtaactttggcaaagttacagatgttgatgtacagatttgacacctttcctttgtatttctttttataatacaaaatcattgatggtatatgtaagttacaactaaagaaatgtgattttcaggtatttgcaagcatttttatgcatgcattgtgtaaaatcacattgcatatcagtgtaaggatttgtgcccttttgaaaagtgaaggaagaatttacttgtgttactatcatgaggactttattattttctttaatttacagaacacttatgttctggtgcatgttttggagtgtataaaagtttgtgtttcccattttagcatgtgcttttgtaacttttacatattaaatttcctcaagttctactaaattgaagtatttagaagtggggataataaacaataagcatgtataaagattctagaaaattcaaaacaaaacagctttgtaatgttcttgggaaaggtgctgtaatagttgcatgcttgggatttgggttttgttgagttcaaatgtgaagtttattttccattaagtatttatcaatttacacattttacttgcaggagaaattttacaattccatgtgataagaactttccctggtcgaggaaatgttactgttaactggaaaattattgggcaaaatctagaactcaattttgctaactttagcggacaacttttctttcctgaggtaatactgcaaagaaaagtcgatcacaaatatctagaaagaatggtgtattttgaggaaaatgggatagaaaagcagcactattgtagttattatctttctctcttctccagacctacttcgtatgaattctttgatgatgtatttaattgtttttatcttccttctcattgcctcaatattaagccaagccaatattaccctctgccttgagtagtacattggacttttaatgactagtgtccctgcagcacttgtcttcttttctctgctccagttttttctactcaccattgttgtagaaacctctccaactttgtgctttgagatttccaatagtgttacattgctcaataaataagatttatgttcattagctcagcattcaagatcttccacaattagcccctgtctgcttggagcttaggttcccatgtgtcagtggtttttatttatttatttttaagccacagaacttttgtttaaatgaaaatatatttgcctgcacaatttataaggtgaataaaaataaagcaggagatagttcatattcaataacgacagcgggattgatttctttctgtatgacataggggtcgttgaatacaacattgtttgtgcatttgttggatgacaacattcctgaggagaaagaagtataccaagtcattctgtatgatgtcaggacacaaggtaattcagaatttaattttaattttttttggtatattcttttcgtaaaagaaagaaaattgttatctctgtatttaacaattagatgcataccaatttttaaaatgttactttattatgtgtcccctagaaatgttagatcaaaaaaaattagcaccatatgggaatacttatctttatagactaggaaagaagccctgaaacgttttgctaaatggttacttacagaataaaattcatttccgaaggtagaatttttttgaaattaatttgagacttacaagccaatttgaattttggaccaattatatggataaatcaaatttagtctttttttttttgcgacagggtctcactctgtcaccaggctggagtgcagtggcgcgatctcggttcactgcagccgccgcctcccgggttcaagcgattctcctgcctcagtcttccgagtagctgggactacaggcatgcactaccatgcccagctaatttttgtattttagtagagatggggtttcaccatgttggccaggatgatctcaatctcttgatcttgtgatccgcctgtctcgccctcccaaagtgctgggattacaggcgtgagccaccacacccggcccaaattgagtcatttttaagcaaattatctgggtactttcctcagtttctattcaatttctataattctgataaccagtataaccaataatgacagtaatatgtgaagtaaagaaattcatgatcttccacctgaaagaaaaatggaatgtggcttttgttaacctgaagatttgttagagaagtaaatagaacacttttgattaccttaatgtttcagagagtgaggctatgtttccagcgattaaaagctaatgccaaatcactgttagattcctgcctgacatttttaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggtttgtgttactctagaatgaatggggtttccaggcaagtgcttattaatattctacttgtgtggatgaaagccattgctaaaataaatcggggacaggagaaaattaatatttcttcattcaggacagaactttataacttctttatctttgaaaagattaaaggaattatctgttttcacagaaatgctgtgtaattaacaaacataacatttcagcagcatacagtaatttaggctgtctgtgggtctactaatctacactgggcttggccatgggtggctctattccatatgtctgtcattcttctccgggaacaaatggtagcacaaaagaccaagtgaaaatgtgtaaggccccctgaggtctagggttagaaccagcacatcatcatttttaccttgttctattggccaaaacaagtcacatatccaaattcaaagtctagaggcagggaaatatgcttttcccacagtgagacacccatgagccatcacatggtaaagattatggatataggaaggggtgaggaattgggaccaataatactagctactaaaggtgcttttaggaaaggcaaaaaattcacaaggggatattattgtaaacatttagataattataaaacatttttgcaacctattcaattaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggtaaaactcttttttttttttaatcttagggggagatagtttaataagttttttttattatactttaagttttagtgtacaagtgcacaatgtgcaggtttgttacatatatatacatgtgccatgttggtgtgctgcacccattaactcgataactcatatatttttccttattattgtattaaacctgaagtaactacatagaaggtagaaattgatggaagagtctatctataacataagtggtaacatttagtaagacacttctagtaactttgcattttaagacatcaagtttcatgaaaactaagtttacctgagtttttttctattagtaaaaaaaaaaaaaaattactctgactttaatatcaggtttggacactctacaattataataccagaaacctggtgaattctcttctgcttgttccccctgctggtacctttaaatcatcttatttcttttcttgattttgttgttgttgttgttgttttaatcatacaggggtttctgttcttgtttagatagacaggcctgctgttatgtattttattacagacatgtccgtgataaagaattttcttagggcagtcacctttgagatgccatagacctaagaggtttcaaggagtattttgattacttcaaaggattctttggaccagaaaatccgtgtatgtcagaatctttgttggtagtaggaccacttaaattagagatagggagaaactcaccagaggcagatggcacaaaatgcgattatggttacattaagcttagcataatcattaatgattgaaattgcattttaaataatttttcatattgtggaatctcatgttgttttggggacttagtgtatcagttacctaaatacagttccaagaggtttataaaaatggtactcacggagggagtaggagatagtgtgtaggataggggaagggaaagagggagaaagcatgaatattgcagttgagaaaatatttttcaattactatgtattttgggagttctattttaaaatgtattttattatcttggaggcttgtgcttttacagaattataagtggtgtaaaccatctaccaactgaagtcagtaacttattttgttgattactgtggcactgtgacctaatataacagtataaaaattccaaagctgtaaaattaaaggtaatattatgtcagtatatgggatataacacaagatttgataaagctttcaagtaagttatctttcaaatgtatactctattaataacaatataaataaatggattgattattccttagatatgttagtttttaaagcagagaatacacagtcacccttcttttctctgaggagtctagatttttttgaacattgggtttttgtttccacctttatttgatcctagatctttgcaaccttttctgctccctgattagcactaagattaagagactgcaggcctatgcatataggagcaagctgccctggggagtggtagggaggaagtattgcgtggggggtgggggacattaagagtaggcacagcagtccttctatatcactgaccttgtaactcatgttggtccatatattacataagacaatctagagaccatgattttcacttatattttcacatggaaacatgactccattaaataaagtgaggagaaaagcatatgttggtgagtgtgtactgacattatatatgcataaatatacatacacattgtgtttctttgtaaatattgatggctggctgatcactcttgacatggattttgctaatccttatgtttttggtatctgccttgttttcattgctattatgtggactggtgattaataataatagctattaattttaaagcattttctctaggccaccctacacatatgatttgtgatcattattacaatctcccacccaaaaggagctattattgccccgttatagagatagtagaattgggagttctaaaatttaagtaacttacttaaaattatagaatttggtactaggcctccttgaactgcagagcctttttttttttccatggtgttctattcctccttctacacattagatattaaggtaatttcaaatgttttgttcatattatgcttaaaataattaggcttatatatttatataattggtttacatattatataaatctatatttaaaatgttaaaatatttaagtggtttcatgtgggtcaacctaattacttcctatacaaccaagtataagtttaatacgtttatgtttattttttctaatttacatctgtctactttatggttgcatttttgtatcttctgtatactaattatacagtttaatttaaaaacagtttctgagggttaattactttgagagtataactaaaggaatttaatgagtgtaattttttcaggatgatgtaccagagctagaagaatatttcctggtgaatttaacttacgttggacttaccatggctgcttcaacttcatttcctcccagactaggtatgaggggtttcttgtttgtttctttttgctcacttcaaatgaaatgaagaaacttcatttttgaatcagaagtgatcattgtgctgttttgttaatcttagctatgtgttaaaatatgatgggcttttatatttatttttgatactctcatatattgcaatttttacaatgaacaatgtaaagacattaaaaattattgtgtgatgctctttaaattttacaactattttataaacaaatttgtaatcctcaaaatagctctttggaaggtattttcctttcattttcttttaaaattagctgttttcagtagatctccaaactctcagatgtttttattttcttttaggttaagcagtgctgatatttgcttctttgttgctttattgtgttctctgcttctttcatgaccttttatctttttcttttcatgcttttagaaaagactcagttaattcattacagactgaaaggtaaaacctgagccttggtacaaacttatctagattcctttgaaaagatgtattcctatgtttaaacacaaactcctctttcagtgtggacatttactactgggaaattttgtctgaagcctgtaggtgtgatggcccactagagggtggtgctgagttggttagaaggagtgctggacaggggaaagttaatttggattaaaggaagagaagcatggccaggagcagtggcctgggaaacaggcattcctcattcatttctgaagctcactgtgataactttgaaaatattgaaaggaaataatcagtttctaacctattgtttgaataaattcagttcttttgctaaagaaatagatgattccaatgagtaggctgtttacatcaagtattattacaagataattattattcacactaagacaactaacaaaacaattcatatttctttcatcctcttactgagataatttgaatagttaacttctgttgagtggtttctaatgctcctatttcaagtgctttgtagattagtaatatcattacttacattcttctcattttacagatgaggtagcttaggctaagagaagctgcgtaatatgccccaaatcacacagctggagactggtagagctgacttcaatggtgtggtctgattttagaatctctgctttttagcctcttgtctgatggatgcaaaccctgattttatatgctttcctggacagtgttgttcttttcactctacagagaattacactctccctaccctttccccatccaggcagctaccataagtgtcctagactaaggtagcacctctgaaatttaaaaggtaaagaacaaagtattaaaaacaaaaatcaaaaccaaaccaaaacactaatcaggagcaggattagttaatattttaagactagcccaggagcagggttagtaatattttaagactgaaaccaaaaagccaaccaggagcagagttagttaatattttaaggtattggtaacatactaagtttggtggatagaataaaaataaaaagggaagataagtttactttgatattaatctctcttgacttcaccaaactttttccccatctttcccatgtgtctctacttctgtttgtgtccatgtctctctgtgtctcttttgcacacctctgttttctctgtacctttccttgcacttctttcatttatttttcatttttttttgctctttctactccttccaactgtccccattttcctttcctcctgaaatagtgatattatagaatagagatgccaaatatgttttaactaattaaaataatagaaacaaaatagtaatctcagttgtttattattttatactgttctcagttgattaaatttctataaatcagtggctcttgttagccaaaagtgtccttattcagacgtgataagcattgtctctttattttcttaaacatcttttgagtaatgttgataatacctgtacattatgaattatataatttcaaagggactgtctttaaatcctatatcaaaaatatttttaatcatttatatgtattttaagatatgcttctatgttttttaagattcagaaggtttgactgcacaagttattattgatgccaatgatggggcccgaggtgtaattgaatggcaacaaagcaggtaaggccaaggctgcatgagagccctcttctgggtttcatattatttactatctaccaaataaaagtttctaagggaaaaattaattttttttgtttgtttttgtttttttgctatattataggtttgaagtaaatgaaacccatggaagtttaacattggtagcccagaggagcagagaacctcttggccatgtttccttatttgtgtatgctcagaatttggaagcacaagtggggctggattatatcttcaccccaatggtgggtctcaaaatctatcacagatgacttttacaaattattttataatcattattccttgagaattacagtgatttaggtcccatataaataaattattcttaaaaaccattgtatttttcacagtaaattaggacagaagatttcctcatggtaaaatagttcccttaactattttagtaaatataaattgaattttcattactattctaaatgttattctgtatgcattaactatttcattacagtatttgatactagagaatacaagctgtaatattaaagaatttatatcattagataatcttcccagaatgtttcttacacttcacgaaaattttaactctttcatttctttgtttttgctcactgaaacacgtttagtgttttaaaatacttttacttggtctcttcatgccttttatttcttagccaaatgtttactttcttctcttcccctataatttttttggagacaaagtctcgctctctcactcaggttggagtgcagtggtgcgatctcggctcactgcaacctccacctcccaggttcaagcaattctcctgcctcagcctcctgagtagctgggattacaggtggccaccaccatgctaattttttttgtatttttactgtattttatatttttagtgtattttaccatgttggccaggctggtctctcaatctcctggcctcaagtgatcagcccgcctcggcctcacatagtgctgggattacaggcgtgagccaatgcacccagccccctcttaatttttactttttaaacttaatgttgccaatttaaataaaaagatataaaccaaaatataaggagacaaaattcaatgtaaaatagcttattctttacattcacaactatattgtatttctttccaaacattctatagaaactcacagtgtatataaatataatacattctgcttttacctttttgaccagattcttcattttgctgatggagaaaggtataaaaatgtcaatatcatgattcttgatgatgacattccagaaggagatgaaaaatttcagctgattttaacaaatccttctcctggactagagctagggaaaaatacaataggtaattaataatttcttataaacagcttcctctccttcatgctgggttccttaatatgggggaagatgtaaaggaatgagaaagtcttggtggttttctgtgcttaaaatgagaatgattttaagttagagcatttcagaattcctgtgtctgtgtaacagtgcctctcacgtgtgtatgttggtgtatatatgcatgtatgtaaaagacaaagtaggttgatactacagataatattatttcctcagttattgtaggattatttaatttgtagatgtctttcctttggaatttgaattttgttctggtttcctacttagcaatagaaggaattacaaaggtagtaattctacctttgtagaattactttgtacctttgtacaaaggagtaaaggaactcctttagtgtcatctactctgtagtatttccgcatagtgttgaggtatactgatacttcagacagattatgggagacgtaattcttggttggaacagtttgatattgttgctaagagtcatcctactccattgcttgataggtattgtgctgactgtttagagaaggtaagaaagagacaaaggagaaaactcgggaacatacagaacttgagggttggaagggctcttaaaaagtcacttccgttcattctgatgatagacaagccaaatgaatttcaaggattgaatgctgactgacccttcaaactcctgttttagtcagtggctgagctggttttttttaaaaaaaattttagtttgatgaatatttgcattcctgaattattggcctttatggagaaatttgatttgtagtagaaaatataaaagaattctgagtaacccaaggattggtttttacttttcttgctattttgataaaatacattgatatttctaagtccccagaagcctttttttttttttttgaggctgtggctgttgtttcaagttcaaagagtatatgtttgagatcaaatcattttcttgtagaacatagtggggtggtaaagcgttgtatgaatgaataccatgtgttggttgagaatagtctatgtacaaataacagaaaacccaatgcaaatggatttaaacacatataatttattggtttatttaacctgaggatacagcgacatacacctttagatgaggcaggagcaggacttaatgctgccagagatcctgaggttttctgtctcttttctttgccttttggaatattggcttcattgcaaggctaatgttattcattgtcataagatggtgatcaggaccattcttctgcatttcatataacaggaaagagagagtattcaaattcatgcattcctataaggtccttataaaaatctgattgaaattacataggtgacatgcccacctccatgagtaggagaaaggaatatagtattgggctctctcaagcttactttatatttgtaattttctatttttaaagattaagaaattcctcagagcaaaaagtgctttgacagtgagtcgtttcttaaaccatgccccattgattgaccttgagactatttccaaacccttataaagtttcaataaatatccttttacataaatctctatatatgtggataattaagattatctgttgagtacagtgcatgttgagtgaaaggactcatccgttgccttctttgttagttacatttcaatgtgtacatatacgatagtttctccatatccttaccagcaatttctttagtctttaaatttttatatgccatttctaatgactgaaaaatgtgtggttgtattatacattattgtgcattttttctttcattttcctgattgttagtgagcttgacactggtttgttttttttttactttgtgatcctgtttttcgtatcccttatgtactttcctgtggtttttgctttactggtttgtaggaatagttatatattttgaattcaacactttgcctcttaaatatattgcagatatttctcccagactgtcatttatcttttattataatgtctcttattataaaaatttttttaaatttaaaatatcaaatattttctggtatgcttttaaatcctactttcttaggtcttttcacccaaatgctataaaatattttactatattttctactattttcattgttttgatttatatttacattattgcacatatcaggaatttattcattggtagtgtgtgaggcaaggatacaacttcatttttcttctaaaatgcagaaaataataccctcatatcgtacagagaatgaaacatccattagccattaattttcaacatgaaatatctacccttctttttttccttttttctatccatctacctatcattttcctggactctgttttgttctatttgcctatttatgtgctaatagcatactgctttatttatcatagccttgaagtacattttgctagtttttcaggccaaatatttttctttttctttctctaaattatctcacctattccttaaaaaagtctctttcatatgaacattagattcaaactgagatctataaaacaaacaaactattttgattggggttgaattaaaattatggattaatttggatggatttgacatcactgtaatattgagttttccaatttagaaatataaaatgcctctccagtaatttagatcttttataccattgccttcccttgtgttctctcaaaaccaaactgtaagacaaggatttggacaaggatttagtttatttgagaggtgatctctggaggcctgatgagaaatgaggaggtgagagagaggaaagctgatagatgatgtcctaatgagcagtactgctgtgggcaactgacactcagtcctgctggtgttcctcttagacactgggttgaatgaagcttaggactgtcccatgacaaggaaagaaatctgggctgttcatttaccagctcctatttctgatcatttgagagttgctcttgggtgttaaatttgcaacagttctgtccttactcctgcatgggctgatgctgtcttcaggtagagagagaccactaggcaaataggaactgctgcaggtgactttagagtgggtgaaagggaggtgctgacagtgtctgccacagttatacattaaaattttgtgattttcttcatataggttttatagtttttacattaggctaatttctaagtattgttgctattgtgaataaggtctacttttcttttttttttttaaatagctgatctttagagatattataatagtctttaagaatgtatgatctgaagcagactttctgactttgtgcaccaggtctgccacttcccagcttgtaaacttcttcaaattacctgaatgtccttcaatcataggttctgtaaaatgagaataataatataatcaatatcatagggttattgtgagaattaaaagagttaatataggttaagcaattagtaagttcttaatagtattagttgtaattattattaatataagtgacagtaaaaaatagaacactcttgatttgtgaaggttactcagcttgctttgtgttcttactgtagttctaatattttctcttacattttcttagtagacaatcatgtcatctagaaaatagtgacagttctgactctttccactacttttacaggtgttatctggctgatagccctgggacactgttaaatagtaacaattatgacagacattattattttgtttctgtttttagtgggaatgctgctaatgtttcaatatttgatatttgttgttgacttctgagagatactgcttcatcaggttaaggaagctgccttttatcccaagattactgagtatttttctatcatgattgaatatgttattttattaaatgctttaaaaaattctgtcatttttaagatcatcttaagacaatcaccttaggtaaagagttggcctagttttcaattagacatccacacttttttcagcatttataacctcttctattttcatttgttgctttaatatttttattttggcagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggtacagtaagaagctttaatgagaatggaagtttatctttaatatttacaaaataaatttctcttagatgagcactcaagtcctagaatgaaaaaacaatacttccagcttaggtgttagacaaagacatgattcatttactatgtgacaagtgctgtagttctatttactctgtataaagcgcaactggaaaaatttactattaatagggtaaaagaatatgcaaataataaagaaaatatatgtatggctattttaaattttcagcacatttaaattgcatatgtcactttatattgtgtataaaccatataaaagaaaacccaagccaacttttgtaaacattaagtcccagccaatcatttccctttcaccacatttttgttgaacaaaatgtaactgcttacttcagactgcttgtttgacaacaagaatagtttattggagaaaaaaatgctggatttgggataaatatgatctatactcacagtttaccttcccaaacctctttttctatatattaacaattttctgttcctgctactaaactttattttttaaaacagtttaagtttaaaatgcagcacaccaacatggcacatgtacacatatgtaacaaacctgcatgttgtgcacatgtaccctagaacttaaagtataataaaaaaaaaagcaatttgcaagattatgttgcaaatgtgatttttttttttttttttttttgaggcagagtctcactctgtcatccaggctggagttcagtggcgcaatctaggtttactgcaaactccacctcccaggttcaagtgattctggagtgcagtgacgcgatctcagctcactgcaagctctgccttccgggttcatgccattctcctgcctcggcctcctgagtggctacaggcgcccaccactacaggcgcccaccatcatgtctggctaattttttgtatttttagtagagacggggtttcaccgtgttagccaggatggtctcgatctcctgacctcgtgatccgcccgcctcagcctcccaaagtgctgggattacaggcatgagccaccacgcccagctattcccagctaattttttgtatttttagtaaaaatggggtttcaccatattggccagtctggtcccaaactcctggtgccaagtgatctgcccgcctcaacctcccaaagtgttgggattaaaggcatgaaccactgtgccgggcctgtgattattttgactcattttttattgtggaaaaatacgtgtaatataagatttaccattttcaccatttttagtgaacgtttcagtggcattaattatattcacagcaatgtacaaccatcaccaccatctatttccaaaatttttcatcattccaaggacaaactctgtgcccattaagtagtaactccctattactcctctccctagtaatctccagtctactttctgtctctatgaatttgcctattctagatatttcgcatatgtgaaattatacagtatttacccttttgtgtctgacttccttcgcttagcaaaatgttttcaaggtgcatctgtgttgttacaggtatcagaacttcattcccttttcacagctagattatattttattgtatgtatataccgtaatttttaaatccagctatctgttgtttccaccttttgactcttgtcaataaagctcctattattgtgaaaataaaataaaataaaatagctgattatgttagctttaggcatttttcaagcctgctgtagaaaatataataaatctaaaataatagatttaaagctattttgtctaaaacagtccatctaataattatttttttaaatgatcattttatgtaacttcagcacatttgcaaatgcatattcattgtcatggttttttttcacattttggaaatttaaaaccttaattggtttgtgcaagatcacttacatttaaatcttgaaatatatatataaaaattcaaatttgaaatattttattaattttctattgctttattcatgttttttcatctttaaaatttttctcaaatttgttgtttttttttactgtgacttttttcataaaagactcctttttcacagtatagctatatacttttctttttattaggcaaattaaatgttagagcaaattggattaaataaattttttaaccgacataactgtttttattccaaaaagtttttattttgaggtataagtagtaaaatacacaaatcttaagtatatggcttagtgactgtaaagatatatatatacatacatgtaactaccactcagattaaaatatttaacattaaagctgggcgtagtggcacacgcctgtaatcttccgggggctaggcgggcggatcacttgaggtcaggagttcgagaccagcctggccaacatagtgaaaccctatctctaccaaaaatacaaaaactagctgggtgtagtggtgtgtacctgaatggtactcaggaggctgaggcaggagaataacttgaacttgggaggtggaggttgcagtgaacagagtgccactgcatttcagcctgggtgacagcacaagactctgtctcataaataaataaataaataaataaataaataaataaataaataaatgtatttaacattatcatcacccggaagattccccctgtctcttcccctttccagaggaaactactttctgatttctatcattgaagactcattttgctggttcttgagcttcatataaatagaatcatacagtgtgtactcttttgtgtctggcttctttcactcaatataatgtttaggtctgtatggttgcatgcatcagtagttggacattttttttaatcactgagtagcattttataaaatagaccactattggtttgtctgttctcccactgatgaacgttcggatgtttctaatttgtgcctgctatgactacaaatgtttttttaacagtgaaccctagattagaatgagattaatcaagttatgtagccagagcaggacaaaaagttcacaaaaatgaagacatagatgtaatttttaatcaatgttattttaaaatgcactaaatattttttggacactttagtgcagtatatcacaaagttgaaaatcctaaaagtagtaacctgaaacagatgtaaccatcacattataggaatcagtattaaatcaaagtgagatgatatttttcaaaacatgctattttgttgtcagaaatgttcagtagatttcgctatatatgtgttacaaaaatactgtattctagtaaccttatcttttgattttgttttcaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaataggtatagtttattcataaggaaattatcacttctgaagctataagtagggaatattttttgacataagaaaatgcagaaggaaattgatatctgattattttaaaagggatttttaaaatgaactctagaaaagataggtctagagagaccagttactctcctaactgggagtatcaaaaacctaaactcaccctgttattagaatggtgttattagaattcttattttctcagagttcacactttcaggtaaaggtctgtactattttgtgttttaaaaataataaaaagcaagaaataatagaaagcagacttaactgctcaaaccaagtgaatgactcttcaaatatatattaacatgattgtggttttaaaatttcttctagaggctgacaaatatttattttttatatcataaaaatattttaatagatctagtttcattaatatgttaatttcctgactcatttttttcctataaagtgtttttgatacatgtgtgaagaaacataagaatgacaattttatttctttttcagaatatagagtgcaaagttactgaagtaactgatttttagtattttcttatcatctcatcttggattgtgtaaatttaaaaatgtattaagtatatgctagcaatatgatatatatttcaaatatgtagaatgtatactttttctgcttccctcaatccatgtatttctttcagagccacctccatagacatcgaagaagccaataggaccgtgtatttaaatgtatctcgaactaatggcattgatttggctgtgagtgtgcagtgggagacagtatctgaaacagcctttggcatgagtatgtttcatttcttatgagaacaaaattctgtaacgaaaaaatattgcatgtataagatttatattttttcctttgaattgtatgttattgatcatttgaaaatggaaaacagataatctaattcttttattgcatctataaatatgtgttgaggctgggcgctcatgtgttgaggctcatgcctgtaatcccagcactttggaaggccgaggcgggtggatcacaaggtcaggagatcgagaccatcctggctaacatggtgaaaccccatctttactaaaaatacaaaaaattagccgggcgtagtggcaggcgcctgtggtcccagctactcgggaggctaagacaggagaatggcgtgaacctgggaggcggagcttgcagtgagccgagatcgtgccactgcactccagcctggtcaacagagcaagacttggtctaaaaaataaaataaaataaaataaaaataaaaataaaataaaataaaataaaataaaataaaataaaataaaataaaataaaataaaatatgtatttagtgcctatgccaggcatggcactgaactcgtggatcttagaatttaggggatgggggtgacagaaatgaatcaagtaagtaaaaatcaatgtatactttaaactttagtaagtgcttttgtcaaaggagaagttctaagtgttgaaagaatataggggaatgctttcaaggggtattgatctttgagctaagactgaatgatgagtagagattgattatgcaaaggactgggttggaagaacatggaggtgagagtgagaagctgtgaaggcagaaaactgaggcataaaaagcacacataagtgaagaacttgagtggatagtaggtacagaaataaggaggaatgttgagcttggatagctggacaagaccatatcattcaagaacttaaggaatattttatagttgccagtctttataatagtgttaatggaaagccttcgagtggtttaggaatggaggagagttaccatatgtaatgtggtatggtataatcatatatggattttgaagatattattcacagtgccatgtaaataatgggttgatacagaagagaagtgaagatacagggaggcaagatggtggtagcttagactaggtgttgagtatgaaggtgagggacagggaagtaccaaagatgactcaggcttctagcttgtgcagttggatgggagaaggggttcatgctattcattaagatggaattccaaaaaagaatagatgtattttagtaaggggagtaaaataaatgtggtttaacacattttgaatttgagttacttttgagaataaatttctctagactcaaaagaaggtctctgctgggccgggcgcggtggttcatgcctgtaatcccagcagtttgggaggccgaggtgggcggatcacctggggtcgggagtttcagaccagcctgacccacacggagaaaccccatctctactaaaaatacaaaaaaaattagccgggcttggtggcgcacgcctataatcccagctacttgggaaggctgaggcaggagaatcgcttgaacctgggaggtggaggatgccgtgagccgagatcgcaccattgcactccagcctgggcaacaagagcaaaaactccgtctcaaaaaaaaaaaaaaaaaaaaaaaaaaaaaaaaaaaaaaaaggtctctgctggagagataaaccttggaactttagctatatatattgtatttgaagtcatggaaattgatgtaataatctgaaaagaaaggctgaagatggagaagggaagaggacactatagactgaactataagaaggttcaacttgaatggctgaggatatgggatgatggcctagcaaaggagacttaggggacctggtaggaaactcaggagaaaacaggatggcagataccagcagaagagtgctttaaaatggaggaaaaagtaaacggtgtcaacccctggtgagaagtccagtaaaatgagaacctggaaaataattattataattagcaacatagaaggcattaatgaccatagaaagggctatttgtatagaaagatggggaattaataccattttgaatagaggtgaaagaagagagacctcaaatatatgcaaccatttcaagaagtttggcagggaagataggacctggagaaggtagtagtggtgtggtgtcggaggttttttgcatgtttagtttggagagacccaagcatgtgtaggttggatggaaaaggtagagaaatgttaaatatttagaagaaaaaggagataattaatagtggtatggttgtctagaagacaagctgagatgggatccaaaaaagaaagtctggtttctaatttagatttctgcattacgcttggactttgcatgtgttttttggaagtactcatgagagcacatgtcggagattcttaattgttagcagtcattgcttattcttcatttgtggtcgtcttgaattattgtagagaaggatttgtccatatgtcaggaccatttgggactctaaatgaaaaatctgcagtatacctttaaaagggagcaacataaaaatttaaaatgctggatttttaggaaaggaaattgctattggatattacatgtaaggcattgacaaattctcttgaattagtaatctaaaaatgatcaatcatttatagggagcccaggtttcaaccttgatagttgttcttactgcatcatgttcacaccattaaccaaaatttaaaaagaacttaatgttttggagggaagcagccatgttaagagactatacattttttaaaaaatgtttactcctcattagttaggggatttttatttttgccctttttttttctttttttttgtagtacagaattttaaaacatgtaccagttgtagcagtttgataaaaccttgacagccatttgaaatatgtgagtctgcttggcattcttaaaatgtataaaatgtaagtgaaaaattagataggcataatttcaaatttaatagcgtaaattttttaaaccaaatatcatatttctataaaaagtatttattattataaaatttctcagttatattttcatcagctttacagaagttgataaaaatcatgttctgcatatttccctttaaaatatacatttagtatttatttagttagtttttgagccagggtctggccatgtcacccaagctggagtgcagtggcactatctcggctcactacaacctccgcctcccgggttcaagcaattctcgtgcctcagccatccgagtagctggtattacaggcgcacaccatcatgcccagctgatttttgtatttttagtagagaacggtttcaccatgttggccaggctggtctcaaactcttgacctcaagtgatccacctacctcggcctcccaaaattctgggattacaggcgtgagccaccatgcccagccacatttagtatttatttctaaatacaccttggaaaagtatgtgtaggtataaagcagagctttaacaaattttcttggtttttaaataataatttaaaaatattcttatttgtagtacaaattcattatttgtagttattttaaagttttcccacttgtgtcttttcacactcatacacacgtcatgaaagaattttcatttgtagtcacaaatgcacttgtctcattgtttaaacaataaattagaatagataagtttttgaaggagtaataaactagtaaaccatgatttgtgtttttcagggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggtaaacatcagtatttttttatagtacaaaaataaaatgtgcagataaattttagatgtataatgaataactgtattcttattcctcattttctaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtaaaaacattttcatttttaaatagattactttctttaaaagaaattaagatttgtaagattgttcaaattggaagataatgtatgttttatgttaatgtgaaaaaggactttttgtgagttgatatacattttagcaaagtatcttaatccggggatatttttgtctttttaaaatgacacttagttatgtgtagcttggtattaaaattttttaagtcttgcacttcagattttaactcatgctattagtgtgttcagtggctttcttagttcaactctcctttaagttttcattcccactctgtccttgcaggtacaaacaatcattattctggaaagttctcaagtaagatattttacttcagacagccaagattatttaatcattgcaagtcaaagagatgattccgaattaactcaggtttgattcttttaaaatgaagtgggtttttttttgcttttctttttaacattataattgaaatttaccaaaggtatggtctgctggtttagtataaaagaaaaccaaaatttgattgtggtaaagtagaatgtaaagactggttagttaaaagttaatttttaaataccagagtcataaaatgttatattatcttcaagagccaaggataatgtaacaataaaaatgaacatttaattagaatttaactgaattgcaaaacattgtggagaaacatcacacagccagacagagtatcactaaaaattcatgattagcattgccacacaggcattcagtatcacctcagaaatcccacatttctttagtaaactagatcttgtaattctagtaatgcttatttgataacttttgtcactccttaaacttccatacatgcttcacaattccattttcagctaattcccttgttgaagtgaaagctaccaaaaggggtattattcattttcccaacaccaaattcaaaaacccacttgaaacccaatcttagtcctcattcctgctacgacagagaaagtgtcccttctaaaaagccaggcctctcacataagtgcccaccttgtccttataaggtttagctattccctccatctctgacatctctctctctatttggttactacaatcagcctaaatgttctagcttcacccagcttaaaaagaaattcctcccttgatctcattcccttctagttttcatttcatttcctttctcccttctatagtaagacatcctgaaagaattttctacttgttttgtctttacttccccgtgctcaccaatgacaactgcattaccagatccagtgggtgtttttctgtgtaatcattatacattccaccagcatgtgacagtcacctcatcctcaaatataaatcttaccttgctttctaacacactacacaaattttccttttccctttctctctctgggtatgtgtgtgtgtgtgtgtgtgtgtgtgtgtgatccttctcagtccccattgccagttcctcttccctttcgtaaacttagatgtcttggagttttccagaaagattcacttatagttcaaatttcttttttctttctcttcactcacttggatacttttatcaatcctgtggttttaaatatcagcaataggctagcgtattttaaattatatctgtagcctttcctctgtattccaggcctacatacctaactgcctattgacatgttcacttaaatatatttttggtacataatatttaacatatcccaaactgaacctttgatttccactatgaaacttgttacttcagtgctagctttcatctcaggaaatagcaaccccacgaactcagttgcttaggacagaatcctgggatatttcttccttgattactcctttttattagtgggggggatggggtctggctctgtggcccaggcttgagtgcagtgccatgatcacaggtcactatagccttgacctcctgggctctggtgatcctcctaccttagcctcccgggtggctgggtcaacaggcgtgtgtcaccacacctggctgattttttgtattttgtagagatgggatttcaccatgtttctcaggctggtcttgaacttactcctttttattctttcacatcgagtttatcattaagtatttttgattatatgtgtcaataagtgaagacattttgtctctactcctccctactccaggtccccattatttctcttccacaccattatagtgtcctcctagctgttctctgaatttccttgacctcctcagatccattctccattgagtaactggaggcattttttaaaaatattaattgactaatgttatttctgattttaaaaccactcaatgatttgcaattatacttagaataaatttgaaattatttaatatgggcttaacataggatagctatatttcctgatttgccttggaaagtactggattatgcctgttctggtattgttattaatattgcccctttcactctttaaaggatccctgtttaggtgattaattatatggtcatcctaatggaaggtactccatgatgatcttacctctccagccttaactctcatcattctcccagcactatcagattccttccagtctttattcagataatgacaaattttttctgtcttaagaactttgtcatgttgttccttctaacttgatttcccaaataccttcataattctctatcagaccatcctaattgtcatcttcagtacttgactcattttatacttatacattgacttaattattgatatgtttcttgtttaccttttcctaatagttaataagatccataaagggaaaggtcgctgtatccatagttcttagcataatgtctgtggctcaaaagttcctaattgttgactgaataagtataattttctgtgacattgaccagcttgccttcaggtagggtctgaattttaattttgcatttatgaacacttaccctgaaaacttgcatacgttgactgccaccatggggacagaaaggatttaggtgtttctctgtattctattgctcgagcaattgataataatattgcagcattagaatgtttcttattccgttctaaatttttcatatgtagtgtatttcctggttttagctttccctttccctgctgtcaacaacccttacccagatgtacatttgatactgatttcttttcaaatatcttctctttcattcactctgtgtgtgtgtatgtgtacttatgtgcatagacatatatgtgcacactcacacagattagataagggagagagcagcaagggagcatcagttttagtattttcttatttatgaaagtatctttttaactaaataaaaggatccaagagagtaaacatatggtattgattacattcttgcaagtgctaaattcctagtcataaagggttttgtatttcaacatttccttcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggtgagaagataaagtatttgtagtgtatatataattattgaaatcatctagcattcatatggtatattttatatgaaaatgctcttgcaataattttttactaatccatagaatatttcttgatagataagtattaattgtcagctgtaaatggatttttgagaaatatttaagcattatacccctaatcttgtgttctgactactacctgaaagttatatgaaaacaaaattggaagtaggtaggtaaagttgaaagatacatgaatattttatacgcaggatgcaaacaagtaactttttatatgtatttacttgatgtgccatgaataatttatagtattagtaaataatgttcagaactttttataagactctttcagaatattcttggaaggaaaatttgctttctgctgctgagtagaactttcatgggtaaaattgcaacattcctaaaaaaattaaaaaaaattgtccttgttctttctttaacattatatcatggttaatgactaataatgtattcccgtcatgcagtaaatgcaaaaagacttttgaagtacttcctattaacttgtatttttattggactaaatggattctgaggaaatttgtttcttgatatttttattatagttttattatgtaattttgtcatttttttctgtaacttttgcattaagatttgacttctatttcattattgcaggagatcagaattcaattgatattttcatctgggagatgggacagtcttccttcaggtattttcagtctgtagattttgctgctgttaacagaatccactccttcacaccagcctcaggaataggtaaggacttttcaactgctcaccaattctaaaggtagtatggaaagccagaatgattttaatctcattgatttagatttagtatcacattgccagacactgggtatttttttttttttggagatggggtctagctgtgttgcccaggctggagtgcagtggggcaatctctgctcactgcaagctccgcctcccaggttccgctattctcctgcctcagtctccccagtagctgggactacaggcgtccgccaccatgtctggctaatttttttgtatttttagtagagacggggtttcaccgtgttagccaggatggtcttgatctcctgaccttgtgatccgcccacccaaagtgctgggattataggcgtgagccaccacgcccagccgactctgggtattttaataggaatgtaacatcaagagctttacaatactccttccagaaatcctataattttttgaaattcttttgaatttcaattttccttttgcagattaatactttcagaatggacattggcttgagaataatcagaataactaaaatatggaggaaaatattagtgaagaatgaaaataatatatttcttttgtctagagaaacatgaagagtgacattaaatatatatttttaaaatatgaaagtatgtatatggcaatagcaagtatttgcatttatgaattttttttaagttggagaatgactatgagaattcttccatcttcatgaactctcccaacctcctccacagtctgaaatcctttcttggtcttctgtactttaatccacacatcagaaacataagcaatatttttaatcactgtggtttcagaaacaaagtcgattggagagaacccaaggtattattgctgtctgcaggttgtaggattattttagggttggcaaggaatcccttgggtgggccagtgatgataaggagatgaagctgaggccagtggcatggtgagcttatcaagctggctcatggggtgggtgttcatagcacagggaggagacacagacagtgggtcatcatgtctcctgttgaggtgtctagagaatttgtgagccaagcctgagtggctccacaggtgactctggatgaatcatagtcctgcttttaaattgagatatggcaattctgtatgaattaaatggcacacagttattaatttgatattatatgtaagtcaatgttaccatgctatgaagaattcctctacttaaaagccttaatgtatggttggagaagcaagaaaaaatattaagatactaattcaaggtacaggactatattagtccattctcacactgctttagaaaactatctgaaactgggtattttatgaagaaaaaaggtttaattgactcacagttccacagactgtatagaaagcatgctttgggaggcctcaggaagcttacagtcatggcagaagggtgaaggggaagcaagcaccttctttacatggtggagggaaaaagagagcgcgaagggggaagtgctgcacacttttaaacaactggatcttgggagaactcctctactatcacaagagcagcaagcgggaaatccgcctctatgatccaatcacctcccaccaggtccctcccccaacactgaaaattataatttgacatgagatttgggttgggacacagagccaaaccatttcaatgaccaataccatttgctctgtgaggggtagaattggagtgattaagagagacaagagaaagcttgagctatgtctgcgtggattggcaggacacactttgggcagagggaaaggtatgagcaaaggagaaaggcagaagtgtttatagcattgaggccaccattggtagatgaaagtgccagcgacagaggatttgaccagaatgttgtggtgctgagattggagatacaacactggaatctagagaagatggcctggaatggcaggcacatggtgcgcctgtgcctcaaatcatccagcagttttcacacattttgctcttagaatctattcatatttattgtgtaagagattaaaactgagaaatgttaaagtcatctattttaaaatgacagcaatatactcattatgtgtaaatacaacgttatttttaaaaaacactttctaaaacgaacacttttatgagaagagtggcattggttttattttaatttttgaaaatctctttaatgtctggtttaatacatggtatatagattctactttatgtatttaattaatttttttaagggacagcattttgctcatttgtcaggctataatgtagtgatgcaatcatagcttactgcagccttgaacacatgagttcaagccgtactcccacctcagcctcctgaatagctaggactacaggcatgctccatcatgcccacataattaaaaaaaagttttttttaaaagtggagtttctttgtgttgcccagcctggtcttgagctccaggcttcaggagatcctcctgcctcaaagtgctgggattacagtcatgagacactgtgcccaactgattctcctaattaattaacttttttccatctttattaaggcttgattgacaaacattgtttatatttaagatatacaatgtgatattttgatatacatataatgatatgtatttcctcaattgagctaattaacccatccattacctcacatatttacctttttttgatgaaaacacttaaaatctagtctcttagcaatttcaagtatacagtacattattgttaactatagttattatgctgtagattaggtccacagaaattacccatcttataactgaaagttggtagtctttaatcaaaatcccccatttctctcacgccctggcccctggcaagcacagttctacaatttgcttttttgagtttgactttttcagattccacatataagtgagatcaggcagtacttgtctgagtctgggttctcatgtctgcatctgaattcagtctactccagtattatcagtcatttagcctctgctaagttctgtacactcatgaaagaatgagaatgaagtagaaaaacagcattattatgaaaacagcattattttcattttattatgcaaacagttttgacctctgaaatcctctaaaagggtttcagtgtctcttagatccctggatcacactcagcagtagtgagatagagaaatccttgaaggcttttcaatggcaaatgatgatcaaaggcatgttttacaactcctcatagctttggtgtatagaatatgctggatgaagtaacttgcaactgcctgggcaagagttgaagagggcctttagctggggtgagaaattaggaatgaagattcttgtgagaaagagaaattagaaatgaaaatccttgtgggaaagagaagttagaaatgaagattcaacagcacttgatgtctgttcaaatgtggggagcaaaagttattataccttggcaactgggaggagaatggttttaaattaggaaaagacacagaaaatgtctgtagtgggaaatgtgatgaacttgtttataggtgtctttagtttgagataatatagaagcatgtgtaggtggttagtagagatgtggaactagaatcagaaagaaattggagttaaaggtttggattttggagacatccatgcgtggggatagtcgaactcataaatgttaaagtgtacaaagtaaatgatattgattgcgaagactagaagatttagcacaaatacaggagtcagtatttggaatttttcccttaggtgcccaactactgctttctttatcaagcatttaacatttaggcagtgttaccttcagtcacctcaactactgaccaggaatcacggttatttatgtctaacttttaaattagtattatttttaatttacaagttataattatattacacatattgagtgtaatatgatgttttgataaatgtatacaacatggaatattaaatcaagctattaacatatccatcacttacttaacatttttgtgatgatacagttgaaatgtactcttagttattttgaaatatactatacattattattgattatagtcaccctggtgtgcagatctcaaaaattcctcctgtctagccaaaattttgtaccttttgaccaccaacttcccattctcttgctcttccccgccctggtgactattgttgtaccctttgctatgaattcaacttttaaaagattccgcaactagtgagatcatgcagtatttgtctttctgtgcctagcttatttacttggcataatgtcttccagatccatccatattgtcccaaatgacagaattttgttctttttttgaagcagaatagtattccatcgcgtatatataccacattttctttatccattcatctgttgatagatatatagtttgagttcacattttggctattgtgaatagtgctgtaatgaacatgggagtgcagatatccctttgacatactgatttcaatttcttttgacatattcttagacagaagtgggtattgctggatcattctgttcattgttgggggaacctccataccattttccacaacatcttactagtttacgtttctaccaacagtgcatctgcaagcatttccttttctcctcttcttcaacacttatttttgtgtaagatttattctaataggtgtgaggtgatagcttattttggttttaatttttattttcctaatgattagtgatcagcatttttttcatgaacctgttggccatatataaggcatcttttaagaagtgtcttttcaggtctttagcctattttttttttttttttttttttgagacagagtcttgctctgtcgcccaggctagagtgcagtggtgcaatctcagctcactgcaacctctgcctcccgggttcaagtgattcttctgcctcagcctcccgagtagctgggattacaggcacctgccaccatgcccagctaatttcaccatcttggccaggctggtctcaaactcctgacctcatgatccacctgcctcagcctcccaaagtgctgggattataggcgtgagcccctgggcccggcctagcctattttttaattgggttgtttccttgctattgagttatttgagtttcttatatagtttggatattaaccatttatcagatagctgtatgggtttaaaatgttttttcccattctttgggttgtcccttcattttgtgattgtttcctttgctgtgcagaaactttttaatttgatgcaatcccatttgtctatttttgcttttgtcgcctcaacttctggagtcaatcaaaaaatccttgcccagattaatgtcatggggatattccccgttttcactgagtagtttataacttaaggtctttaatttattttgagttgatttatgtatttggtatgaaataatggatctaatttcattcttccacatgtggatatccaattttctcaacaccatttattgaatagactctctttcttcattgtgtgttcttggcacctttgtcaaaaatcaattggttgtgaaagtgtgagttaatatctgggctttctatcctatcccatttgatcagtcagtctgtttttatgccagtaccaagatgttttgatcataattgctttatattttgaagtcaggtagtgtgatgcatccagccttgttctttttgcttgagatcgttttgtctattcagagtgttttgtggtttcatatgaatttaaattttttttatttctgtgaaaatagaaaaatgataccagaattttgataaggactgcattgaatctgtagatcactttgggtagcatggacattttaacaatattcattccttcaattcatgaatatgggatatctttttatttatttgtgtttttttctatttctttcatcagcgttgtacagttttcagtataccagtcgttcgtctttattgctgttgtaaataggcttgttttcttaacttttttggatagctagttattagtgtatagaaatgctacagatttttgtatgttgattttgtatcctacgactttactgacttcagttatcagttctaagagtttgttttaatgcaaactttagggttttcaatatataaaacatgttgtcagcaaacagagacaatttaatttcttccattcctatttaggtatgtcttatttctttctctcgcttaattgctttggctggaactttcagaacgatgttgaaaggaagtgacaatagtgggcatctttgtcttggccgggatcttggagaaaacctttttcaacttttcaccattgagtataatgttggttacttgtttgttatatgtgacttttattgtactgaagtacatttcctctatacctattattttgagagcttttatcatgaaaggatgttgatttttttcaaatactttgcatcaatttagatgattatttggtttttcttctttattttcttagtgtagtgaatcacatttcttgatctgcatatattgaaccatccataaattccaagaataaatcccacttgatcatggtgaatgattcctttattgcattgttgaattcaatttgctattgtcttactagggatttttgcatctttgttcatcagagatattggcctgtaatttctttttttcttatagggtctttggcctttatatcaggataatgctggccatgtaaaatgaatttggaattatcctctgttcttcaattttttggagtattttaagaaggattggtatttgctcttgaaatgtttggtagcattcagccataaaggcatcaggttctgggactttctttgatatgagtcgttttatgactgatttaatttccttactcattattgatctgcttaggttttctatctcttcatgattcagtcttagtaggtgctatgtgtctagacgtttattcattttttcaaggttatccaatttttggcacataactgtggtagtttctcttgatcctttgtatttctgtatttctgtggtatctgttgtaatgtctctacttttatttctgattttgtttgaatctgcactttttttcttagttgatgtagctaagggtttgtcaactttttcttttaaaaaaaaacaattcttagttttatttatttttttctattgtttttctagtcttttatttatttttgctctttgttatttgcttccttctgttaactttgggcttagtttgttctttttctatttcctttagttgtaatattagaccatttatttgagattttatttctttttcaatacaggcgtttattgctgtaaattttcctttttggactgtttttgctgcataccatacattttagtatattatttttatttttgtcataaggtatctttttatttcttctgcaagtcatttattgtttagagtatatttaatttctacatatttgtgaatttcccaagatttcttctgttattgatttctagcttaatgccattatgatcagaaaacatacttgctatgctttcagtgctcttaaatttgttaagacatgttttgtggcctaacatatagtctatcctgaagaatgttctgtttgcttgagaagaaagtgtattctattgcttttggatagaagattttgtatatgtctgttaggtctatttggtctacagtgtaattaagtccagtgttttcttattgatgtgctgtctagatagtcagtttattgttaaaagtgggatactggggtcccctactattattgtattgcagtctatatcacccttcagatcacttaataattgctttattatttaggtgctccaatgttgggtgtatgtatatttataattgctatgtcttcttgatgaatttaccctcttgttgttatagaatggtcttctttgtccctttttatagttttttacttaaagtctattttacctgatataagtatatctacccttctgttttgacttacatttgcaaggaatgcctttttccattccttcattttcactttatatgtgtcgttattggtaaatagtctcttgtaggcagcatatgattggatcttatttttttttaatacattaagccattctgtgtcttttgatgaatttaatcaatttcattcaggataattattaataggagcagacttgctactgccctttcattatttgttttctgtttgttttgtagatcttttgtttctttcttcttctgttgctgttttcctttgtggcttgatggtttcctatggtggtctgcttttaatcctttctttttatagtttttgcttccacagtagttttctgctttgtggttaccatgaggcttacataaaacatcttgtactcagaaacagctattttaaattgataaaaaattaacttcatagcaaacaaaaactatatttttatgttctctcccctaaaacttttatgattttgatctcagaattttttttgtaatttgtatttcctaacagtttattatagctacagttatttttaatagttttgtcttttaaacctgagagataaatttgctttatataatcaccttacattattagaatatcctgaacatgactatattacttataccattcagttttctttaaattttctcatgttttatgttattagttatcagactttcatttaagcttaagtaactccctttagcaattctatagagcaggccgagtggtaacaaactctcttagcttttgtctgggaaaaatttaattctctcttgtttctgaaggacagctttcctgagtaaagtattcttggtagaagtttttttccccttcttcattactttgagtttattattctactctctcatggtctgcagggtttctgctgagaaatctgctaattagccatattgagacgcctttgaatgcgactatattctctatctcttgctgctttcagtattctttctttgtgtttgatttttgtctgggtaaactcttcattgagttgaatttgactggagaactttgagcttccaatttctagatagtgttgtctttccccagatttaggcatttttcagccagtatttttaaaaataatgattcttggtattttttctttctcttctttgggaactcctgttatgtacagcttagttctcttgattgtgtcacataattcctatagaccttctctattctttttcattcttttttatttttgcttctttgactggataactttaagtatcctatcttttaattcactaattttctttcttctgcttgatcaagtctgctgttgaaattttctactgaatttttagaatagtcattgtattccttatttctagcgtttctgtttgtttttttgtttgtttttatttctttgtcaaatttcttattttgttaatgaattgttttccaaattgcatttactgtttcatctgtattttcttatagttccctgaacttcaagagaattattctgaatttttgtcattcattttatagatctccatttcttcaagatccattattggaactttattaatttcttttggtcatatttccctgatttaaaaaaaatccttatgttggcatctgcacatgtgaggaaacagccacccttttcaggcttttctagtgttctgtggtggtgatagaacttcactatttagtctagcttgggattctggttgggttagttggtagtgaccccagacaagtagactttgttatcatgttttgtatttgggctgggctgttacctgtgacctgggatcaaatggaagtgctggctgtgctctgagatccagtgacatctctggttggggtcttcagtaagtcagagctgttgcctgggcgtagtaattgcctctgatcagtgttgtagattgtcttctctggctggatagtgctgtggtttgggatctatatctgcacagggccacctacttggctgggaggctgggtgaggtgtctagattgctacttaactactcagggtaggcaggactgcaggctatgctgcatagatatgcatggacatgggcttgcctcccatactagggtaaccttaagcacagcactgaggtttggtttagtagctgtttagctgctgtagttgagcagagtcagatgctcccctcagaagacattcacacacatgcacatgactccttgcctggcaagggcttaaggagagccccaggatttggttggattgatgctcactagctgagtctgggcaggactagattcagataattgctgacctgcttttaacttctagcttggagcgaagttaaggaaagtactggggcttggctaagtcacagctctgcagctgggtctgagtagggtcagatgctctctttggataatccgtgggtctgggaagggtcagagggtccctttgtggataatgctgacctgcccttgcttcttggcctggaagtggctgtgaaggagatcaccagggcttggctagatcacagctctgtggctgcatctaggtggggtcagatgctccctctgtgaatgatgacaaatgtacccctgccttctggcctgagaaaggactaaagagtactctagagcttggttgggttgcagctcaatcactaagcttgggtggagctagatgtttactcagcagataattatcaacatgccgctatctcctggcctggggaagttttaaggagagcacgcaggctggctgtggaagctggccagggatttgggcctgggaggcctgtcaactgtgcctcattcagagcaatgctgttgggtattctttctggtggtgtgcctccactggccacaaggcagagccgccaccaagatctgcttgtctgtcactgtgagccctacccctgttcgttgtttctaagtgacctcaggtggtctagccctgttgatagctagtgtttccagtggggcaagacaagggagtgttacctgtgaatgggcccagaatgttggggaagctgaatgtctgcctccaactcaactctctcttccctctgtaaaaacccacagttcccggggaatctcttgtgtgccggactgtgctggcttgggggaggggcaacatagtcaaagagaaactgttcctcttacacttcaattgtagctgttctttgtctgtggtccaaggggttgtttcagcctcactcccatgttctgggatattcatcaaggtattcttgtctctgaatagttgcaaattggatttctgtagaaaacggtggagccagagagttcctattccaccatcttgctgatgtcattctatttacctctcactttttatagattgtttctcacattgtactttgtttccatgttttctactccttcctcctcatccctgtggaatgcccataccacattctcccagtccccagccaccttctacctggactattacatcacttcctggcctccacactatctttactttgccatcagagtcctctgcctgtctctgttctgctcattctttccttaaataacttctctttacattgtcaacactttgactcgtcataaatctgttattatcctaagatatacaacttgagtgacttatcattcaacaagtgatttgttgagtaaattatgtatctttcatcatatatttgtttagtttttgtctacctgtcctttaattttttgcctttattatatttgcttttcttattcctcaagtattcaagtggactaactatgtctccttgagtcacttattattattcaaaatagttgcctaatgaatgtttttaaagatgatgagtgctgcctgaagggccattaattaaagttatagaattctctttaaagatttaaaaaatatataataggcatactttctaaaagaatttgcaaaaaattctgccagagacttattaaaggacccattgtgaggtctctttatttcttttgtttctgtgacttgaggctgtagaagtatgaaaagattgtaggtaattatttagaatggcttattatagatctcctgaaagctgaaattatgcattaaataatgttcaagggctttcttattttgaatgtgtcaaatattttattaaaagtattagattggagctataaccatgaggatcacatatttattctggttaatgacttgacagagattattgggtggtgactgaattctttaaatggaagaagaagaatgaatatgacaaagactacaaggacatacaaacttatcttcgctttcacccttttctcctttagtagttaatagatatttttaagtgcaattatgtgccaagcacattgatagaccctggggaaacaagggtaagcaaaactacatataaaccctgcgctgaagaagttttacaagtagcagggaagagagatattatgtataatcatacatataagtttctagttataaatggataactgctatgaaaggatagaatactttcatactacaaaatgagaggacttgccctggtctaagagatgcccagaaaacttacttaaggaagaatcatttaattgagaattatatgttgagtaggagttgaagaggcagagttgatgatggatcagctctaggcaaagagaggtcaggtggtggtggtgagcatgtgcttttagggaactagaaagggaccaatgtggcccaaatacagacagtaagggaacagtgatactgggtttaactgaagatgtaatcagatagggacttaaaggattatggtctttatcctaaaagtattgagatgcctttcttgaggaggtgatggggaggtggagatagagagatgggcagagagaaagagagagcatgtgtgtgtgtgcgcacgggtgtgcatgcatgtgtggctgccatggaggaaaaacttaaatgttagaagagaagatgtctgagaaagagctggaggcgcattctttagagatgttgaaagatgaagcttggaaagtggtaggtgatgctggttagagaagtagattgattcagatgatgtctcacaagtaaaaccacgggggttggtgatagattagatacggagggagacaagaaagaggatgtcaaagatgagccctaatttctgcaactggtgggtgaatggtagtactgtaacttttgtggtggtgattgcttgggagaggaccaggcttttaggggcagagaaaatgagtttggttggaatatgttaagtttgccattcacatgcagagtaagcactactgattatagagtttagaggagggtcttggtttgctgatatacattggaagtccgtgagtacagaaggtcattttactacaggcagaggttatcttggttgagactattgaatcagctcattttaaacttcagagatgttgagatgcccctgaattaatttttttactcagtgtctccagttttataaaacttgatgaaaaatatatggccatttaaaatgcaaatttattgatagcctttttattgactgccttaactttttatgcaacgtttgctgaagtgtgatagtatttaagtccattactataaataagcacgaacagtggttcttgatatgtaagagtaaggatatggggctttccgttgtaacctatgggctaaaattgtagaagaggctcatatgttcttattcttggtgctattttaatatctaaccaatctcatttgatatcttttttttttttttttttgagatggagtcttaatgtgtcgcccaggctagagagcagtggcacgatctcggctcactgcaagcttcgccccctgggttcacgccattctcctgtctcagcctcccaagtagctgggactacaggtgcccaccaccatgcccggctaattttttgtatttttagtagaaacagggtttcaccatgttagccaggatggtctcgatctcccgacctcgtgatcttcctgcctctgcctcccaaagtgctgggattacaggcatgagccaccgtgcccggcctcatttgatatatttatgttccaatgtgtttatctaggtactggaatttgtacatgtttttctatgatttctcattttttctcccagttttatttaagtctggaaattatttagtattgtatataatatagtaagcccccttccttcttaacttgtgtagatataaatatgtcctttggctattttttacttcttttttagaagcaaccctattaactgatatatatatatacatatggacaagatctaactctgttgcctagggtagagtgcagtagcatgatcatggttcattgcaaccttgacctcctgggttcaaacgatcctgccacctcagcttcccaggcagctgggaccgcaggtgcttgccaccatgcctggctaatttttgttttttgtaaagacaggctcccactatgttgccgggtctcgaacccctgggctcaagcaatcttcctgctttggcctcccaaagtgctaggattacagatgtgagccactgcacccagccttgctttgaactatcaaaagtatggtttcctgataacatttcaaaaacattggaagaatatactttaggagtcataaatttgttcatatcctttggcctaattaattaacttgaagaatttatcaagtgaagataattaacatgaataattctgtctctacttaatatttaataattaaatatacaataacaaatatcaaatgtagggaaattattaaatatattttgatcaaccatatatattatctatgcactgaaatcatagacttgaaaactgtgtagaaacagaaaactgtaatagtatggacatggtgtaatattgttaattaagagttttttgtatttatactgtttataactgtgtcaattatgaattcatatgaatgataactagaaaggaaaatgaagcatttcatgatgggattatgagtatgtttcactttttaaaatatcctaatatgctatctaataaatattaagatgaatataaaagagtttaaaattagtttcggttttagcagccagtaatttcttttttattaaatgggtatggaaacctcatcaagctggcttgatcattctaaagcacttaaaaaattattatttacgtccagttatttcagaaattgaagtatatttagttacctcagaaatcacaatggaactttgagattttggaagattttgctttggaaccgatgcagggagtgtgggaggtgacagtttatatctcactcaagttgttttttctttccttcctgcagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctaggtaggttcaacattttttgctaagtatctttatgttcactgtaattttgtatgacagctcatttccaagtcattatttggtgactgaaaaatatacaaaatataagagctatttatcagcctgaaatttggttattatccatgtttctaatatctattctatcaagtttatcagtattacatgaatattttggattaaaattttcgttatgaaatgttgtgattcttccaaacctttaatatcaattaatgtaatgagtagtctactatgtatatatcttaaatttgttgtagttgacttattttgtatatgcttcttatggtagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcaggtaatgatactgaagaccccacacttgcaatgcaaaatgttttatttattgtatttgtgtattagctattattagcactcagcaagtcatagtttgagtgtcatcagcctctctcccttccctttcccctgcctcccttttatgtgcattctagggtgaattctactgacattttgcaatttacagtcttacacactggactctgagtcaacttgtcctaatcattttattttcagattccttttataggattgactttgaaatgttacaagttgatcttggtctgaaagtttggctctgctgttagctgttaccagagagaaaggatgaaatagatgctaaatgcaatatatactgtgtgatatacacatcacatacaaatatattactatcctattatgctttgttacttctgtggagaggggaagagaatgagaggtggggtggggggagggtggaggagagagagagggttgtaattatatgtatgttggacatgtagatgtcttcctgaggaaagagaaccatgcaaatcctaagttacttccgtgcccagatttcatatttctttatcagcaagcaaaaggacatctattatttgcatcatttagtccttttggtaaagtgaattcttacttcttaatttgagttatagctgcagctatcatgtatctttctctgaaatatttttcatatgaggaaaacctaacccaagtttgcctgcacaccaagagcatgtcctcagagaaagtgagcttcggggttagttggatactctaccatgtcattttggcttagattgtttccatctctctactttgccatcacaaaattgactttcatttggttgtttgaaagctgatgttattgttaaggttactatgttctgctcatgttcatttggggcagagagagatattttatgagattctcaaagtaaagaagacatttcccaaaagactctagaaaatggcttatgtctcattgtccagaactgggtaacaagcccactcactcattcattcattaattcatgcagcagttatttaacaaatgcctgttaggtaccagatactgtttcagatgctacagtcatgttagaaaataagacggtaaaattctttattttcatggtccttaaattctagagagggcaaggggagaaaggcagtaaacacagacataagaaaatatgtactatatctgatggtgatgagtgtactatgaagaaatgttaggcaaggaaggcagatggagaatgcaagggagggagtggaggttgtatgtggggaaatctaaaataggatgatcagtaagggctgtttggaggaaatgacagaatgacaaagactggtgggggatgagggtgtgagctatgtaatatctggggtaggaacatttaaagcagaaggacccatcagcaagagcaaaggccctgcagtgtagccctgcccatctggagcaacaaggaggccactgtggctgatgtctgcatgtgataggggatgaggttcaacaggtgcagggccagggctctgtgtcagggatccccatgaccacccacagtttcgatgagtcactaagaagactcgcaggacctagcatttagtcatatccatggctatgatttattacggcaaagaatacaaaataaaatcattgaagggaaaaagctcatggggtgtaaagtccagaggaagccagggcaagcttctaagattccccctcccacccccatccattgacacaggacacacttaattccccagcattgagttgtcacaagatgtataaaatgttgccaaccagggaagcatactagggactcagtgcccaggattttaactggggtctgatcatgcaggcaccctctgcctggcacataccaaaattctagactctcagaaagaaatgaatgttcagcataaaccacaattattacacagtttaggcactgggagccacttaatagttccagaatggtgggaactctcctgaaattccagttcccagacaccagcggatagccgacctgtgaacaagcctttaaggatagcagtcaggtctgctgtgtgaacactttcctgcataagcccattagcattgtaatgagtttgggccctgagggaattagagagcctttgaaggggaggagtagaaaagtgaatgatctgactcacattttagaaggaacaactctgaccatagtatagagaatagattgtaaatgggcaaggacagaaatagaccagttaggaattattacagtaataaatgatggagctatgggaagcatgaatttgctgctcattgagatatggatgactataggaagagcaggtttaggggataagatgaggagttttggatgtgcttaaagtcttgtgtctgttgcatgcaagggtcagaagtttacactactactcaatctggtccattcctggagctaagcgtagtagatcagcttcctctgaggcatctctgcccaatagggatataatgtgtgcctcatatgtaaatttaagtttcctagcagcctacattttttaaaaagtagaaagaagcaggtcacttgattttaatatattttatttaacccaatgtatctgaaatattttttcaacatacaatcaacataaaattattgaggaaatagtttacatttttcatatcttgtcttcaaattttagtgcgcattttacacttatagactagctacactaactacatttcaactggtcaatagccacatgtggccagtggctactgtgaaggagaaggcaaccctaagacatgaactgggtcttgagtagggagagttagaaagaaacaagaggaccctattcttattaggtactcacttgtttcttcactttcttcagatctctgcaaaatgataccttaccagaaagatcactgatggaaaattgcagctccccaccatcattctgtatctttttatccttataaaaagtttcttcatgacacttataattgcctagtttgtctatcatcaagtttttttttgttttttttttaactagaattgaagagtatgagagctggtatactgctgtgctcacagctttatccctgcacccagaaaagtgcctggcacacattaggggcttaggatgaacctgtcattctgtgggagaggcagaacacttacaaggccttctcaaggccttatacaactctatagggcagagctgggcttcctggggtgagaaccgacatgctctgctgtgtggttccatcttctcaccctgcagccttgcagcagatggagagcacatgctattcctcaactgtttgagaatggtagatttccctttatgaagcttgttccaaaattgttctggagacatacaattactgttattcaatacttgccaatagatactgaattctttcaatctgttcagtagaattcttcattacaggtctttgatgtctggacaatctcatttcaaaatgagatatagcagataatgagaatttcttgaatattttctggctgcatgaagtgctcattttattaaccctcattgatggagggcatggagccagagagagctggctttttaaaaaggcattgtcttttgtgaataaattatgtgcatattttaaaatcaaggcattttatttaggaatgtttgattgcctggagcaagattttattactatgtaacatctgtaacaatgtgttaaaatgctgtgtaaaatattgctaaaggataggatcgctactcaaattagcattctaagtaaaagctctcataagttttaagaaattaatgggggaatctcttttcaggttatcatagtgacctgaatgggaagattttcaaaaatctttacactccatattcttgctttactgcatatggaaaatccaggggtattgtaagaagagattctttgaagcattcattttgaggaacagttcatgaaatggctgacaagagacgttgtgtatgtttggtgaagaatggtgtagtcacacagaaacagataattagtttgggacaaaagaaagaggctaggaagcatagataagaagaaagaaagtaagtaattctatcataagggaaagggatatttcaggcaggaaaaaacagttgtaaaggccatgagctaaggatgaaacaccatcaaaggaggcagaagagcccacagaaacatttccgaggatatgaatttaagaataagagacatttgccagtgatcaaggagaaagctctaattctcatgacatcgttgtgcatggatgggatgttggaaaccatataggtcaagctcttcttttacaaataggaaacaaagacctagtgggattgccagaagttacacagaggaaaaaggcttccctactctcctgactctatatccgttctcttctacaaactttttacatgctatgaatacttttacaaaagtacacgctttctgagtatgaatgtaatatatgttcactgaacaaaatttgaaaaatatagaaacagaaacataaaataatcctaaaataattaacatttttgcttactttcacttagtctgttacttattcaaacatgtgtgttttaaatcatggtcattctatatgactgttttttaattgtcgttttcacttactatgtcatgttgcttaggaccacaaagtttgcaaatccataataacatgagacaaaaaaagaagtctgattaggtaatttcagggaaccccttgtgactttctgtgtattttttcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtggtatgtaatttacaaagttataggaaacacttttaaattatggttactagtgatgtatgggaccaaatcctgccttatggatgaagtgtttgagtttgaccatatcaacactgaattcctactaatcattgtagagagggatacaatttaaggttagttttctggttgtgggtattgttcttttttaaaaaaatataaaaccaaaattgtcctttaaaaagtcattctttctgagtttcagtacattcgttggccacattgtgggtgcattacattgttagaaagataaaattaaccaaataggatcaaaatgtggtttccaggtttaggcacaatggaagtagtaagtagggaacaagtctgtgtaaaacagtcggacttatgaaaaagtagatctgagttgtggagtgatataggttgggcttcctgtaaatagactctgagattgagagttgtggacagaaggattttggggagatacatctatgaggatgtgaggaaggtgaggatgtgcagagggagaagttgatccacaggcaattgcaactgaggttgattgcaactgagttcaggagatgagctggtccttaggagttgttcccagtttagagctaagctattgatatccccattttagcagtccttggctttaggccaccctcagggttgggtataaccttgagtgagacagtttgctgtaggaaagggtgattcccaatgaggagcacagaacctgttgttcctagcagccgagggatgggtacatcagccccaagaagggatctgggcagacgacgagattatctattactggagaatagtataaagttggagctgaggttcaagaatggaataagaatgagccaaataagtacatgattaacaacaagagggatcagagagccttttgttcctagctggaagatgggttgtcttcttggcttgcctttggtttcatagattagtctgtgtatatggcccaaatgcttctctgaagagttcttttaaaggaactctcatggaactgtctcaaaaaaaggacaggtatatatcatggttcatcatttctaggtttctgtattatttcaaacgtgattggagcttctgtatattaagaatgttatagcaaattctattgcatttaatatttactttaggtaagctaccagaactgtaagttgtgtctgtcaggttctatatgttctgatttgtgtttctccagttatcatttcttatataaacatgattacaattatttctaatttaaatatataatggtaccttaaacatagactatagtttggaagaattaattatttcattcagggagctagtatatcttttttctgtaaagggccagatagtaaatattttaggctttgtgagccatttggtctctttcactactgctttgcctttgtagtagaattgtgctaggcaatataagcaatattagcagacaatataggcagcgatagacaatatgcaattgaatgagcttggttgtgttccagtaaaacttgatttgtgacaaatgggtttggccattgggcagtagttttctgacctctgattttattaataaagctcttgaatttatttttttaacttttattttaagttcaggggtacctatgcaagtttgttacataggtaaactggtgtcatggggttttgttctacagatcatttcatcatccaggtcttaagcctagtacccatcagttatttttcctgatcctctcccttcttccaccttccacccttgaataagccccagtgtgtgttgtttccctctatgcgtccatgtgttctcaacatttagctcccacttataagtgagaacatgtggtatttggttttctgttcctgtgttagtttgctaaggataatggcctccagctccatccatgtccctgcaaaagacatgatctcatttttcttttatggctgcatacctaaagaaagaaataccattcaatacagcaatcccattactgggtatatactgaaagttatataaatcattctatgataaatacacatgcatatgtatgttcattgcaacactcttcgcaatagcaaagacatggaatcaacctaaatgtccatcaatgatagactgaatagagcttttgaatttatattctccattgccttttccaggtggaaaaacgaatgtcagcaaaggtagatacatcagcctataatgctagtttgagtaattataaatagtttgtagctgcattgctggagagtggtgtgtgaggtgggaatcagtgaaaaatggcattcaagaagtcctatcagcaaggtcttccatgctttttagcaaatttggatttgactctttagacaggagagacataaaaggagaagagagttgctatgatttgtatctctccctatctttctctctccacctgtgttttagttgattcattgcttagtgatacatctgttcagagttagtcaaaggaaataatccgggcaaaagttttgcagagaaaaatctttaagctagtatgccaccttattttacttttatggatctttgtatatggtatctagaacttagattcccagagagactgtatactttatcttagaatggaattcagtctccagtatttgacaatttggctgcatttttttttattagcttaaagtttataaatggtttgctcttcctttttcctaacaatcttccattaatatgaaagacatctgatttgtagaatcatattattatgttgcttaaatatctcttgctatttaagttataggtttaataaaagaaaatcaatttttaaaatattcttactacatagtgacaattacaaaataaataacatcttctttctttaaaattctagattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaaggtaaatattgttaaatatctttcaagttttaatgagaagcttcattggataatttaattctaatatttataaggaatgtaaatttctctttttatatgactttttcagtttggcaggtcatactcaatcctttttgtttattgttgttaaatctggtaatcatgtgaaattacctagcagtaatgttataggaaatgtgtcttttaaaagatacattatattagaaatattaatattttagttgtgagtacagtagaggtgactgttttttattttactttatctttttcatcattcatctgttctctttcttcactcagctatattttctatagattttcactagttacagagaacaatgagcaacacaatgaaatgtgtacatggcactaaaggtattaattgtttaatccaaaatagtaattagaataattttatcctgtgaagtgtacagtggtcaatttctcttttgagtactaaaatcatcacccaaataattattcatattagctgctggtgaaggttctaagattttcacgtaataacatggacatccagctttcaagtacctttcatttgaatagtcaatgggaaaaatacaacatgtggttatgttcctgggtctttaatatggcaaattaagtttttaaaatctaaacaatgaaataaaagttaggtgctgtgaaatactttgagcctcctgataggcacgtcactgtaagaacaaaatcactcttaatgattagtcattaaatgactttgtatatataatttttcattttttgaagaatcttttgagcctttataattatcatctctgttcaacctgcatatctgtacttccctaagactttgcagcaatttctgttaaagtgtatgacatgtgcaacataggagggtgctttagagaatcagaagtgggggattagaactgggatataatgctaggagtggatggtgattctctgcccaactttggggaccaggaagaccaagcccagaatgatccttgggagtatacattgtctttgttttacttctttttccttaactgtctacaagggatagagtagagtgttccactctaggtccttgtaacagcattgacagcaaatagaaaagactatttactcgtggcatgtttctctcacagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggtaagtcaaggctgcaaagaatgtgatctaaaatagaggaaaattctcttaagtaaaattgtgatgctcttgtaagtaaaaatcttttttttaataaaaggattcttttaaacataaaaatgtaagtattctactgttgccacccacctaagtatttaataatgaataatattttataactggctggcaaaaatgatgtctattacttgtatttattcttgaactggaatattgtttgaatgaattttgaagcactgaatttagattaattatatctgattggatccactgtaattttgttttgtcagtttttaaactaatgacaacaagtgaaatgcccaaatcaatctggttatttttattattcatttaataggacagtattttcctttcatgatatgattacttgaatcaagattagtcttcagatggtttagatctggttttagctatctgtatttatccatgtatgtatggagagagagagaagaacagagaaagagagggggagaatatgtgactatatcagtaatgatgcacaagaaattttaatagtggattagtgttaataatattataaaataataacaaaatgttgttttatattatataaatagtattaatcttatatattatataccatagaatatattatatgttattaaataaatatgatattatataatgttagtgttactaatagtggtattagtggttttaggtaatagtatctcctgaagagtataatttgggaaagatataagggatgggatagaaatgagggttttccccccctttttagagtattttttatctctggaaatttttcattatgcaaaaacaaagtaagaaatttttaaaaattaaatataggcttatatctagattttcaagtctagagcttttgctttaaaaatgtatgtagcatttaccagtgtttcctaaattttcttttgggatattaaatatgtaaaacatacaatagaatatggtcaaaatttcaggatagatttttaaaaattattttatttgctaatgagtgtgaagattccattgaaacatcaccagtgagctagaatattctatagattctgaagtggtcagtgggaatgtattaaaatataacaagaatcttttttatgtttgacagagctgcccattcctgtgaacaaagtcaattatttccttactgaaaaatatcaagtattcaatgcaagttaaatgtcttaaaaaaaaatgaaacaccatctttttcccccatcccccaggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagagtgagatgaactttcatttgtttacagtcatacagaggcctctccctgctgatttggccagtgttttatgtttagctttgcctgtatttatttttaaatagataaataaccaaatttgtcttataaactaattcttaggtctctttgggctagaccaaaggattcaacaagtttactttcattaaatataagagttcagaagaccttttatgcatacttatatctgactattaatttctactttaaagggtgaaatatagaaagttaagtagaaacaataactttagaaagatgacttatgagagttaccattttatcttgcctttcaattatattctttacttaaagggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggtatgccagtcattaacatattagcctttttgagttgtgcttcagacattttgtaggcatccatcaaatgaatgtacattggtgattgctaaatgcattatactctaaatgtttctatgttaagtcaaacaaatattattaattgaaatacaatttattaatgggcataggaagagacttataaagatacaacaatcttacccttttctgaacccccgccccagttttatttaaaataaatagaagttacaaaacaggataataattgacttagaagtgcctaacaatgtatagaaaactgtctgatgaactagactcttcctgtggactttagtttcttttatcttttattttgtttcttaatgccagtaaatatagatatttatttagaatttgcactaaaagtgtggacagtttttacttaatatctaaaatgccctttataattaaaaaaattgactaaaataagagaaaatgaacaaaatagttaaaacttgaaaaattgaaaaacaatattctagatttaggctaaccagtcttaaatattataaaacattccccaagaattacaaattttgtaaacttggcattttgtaatatgtaagaataagatgttttcataccatttttttatcagtaagtggaaaaggcatatgaacaaccatgaaaatgttagtaactttaactagcacctctatctacaggtagccttattttggctagacaaattaccagagtatgcgtcaacttatttgttgctcatggggggcggtagtaaatgctgttaaaaggtaagcatacagatgtagattttcctacacagaaaaacccattattgttaatatttttgaaatcctgagcttttaaagcagatttagaacttgaaacatttcctaagtaaaaagagtggaatgcaatcccagcactttgggaggccgaggcgggtggatcacgaggtcaggagatggagaccatcctggctaacacagtgaaaccccgtctgtactagaaatacaaaaaaattagccgggcgtggtggcgggcacctgtagtcccagctattccggcgactgaggcaggagaatggcgtgaacctgggaggcggagcttgcagtgagccgagattgcaccactgcactccagcctgggcaacaaagcgagactccatctcaaaaaaaacaaaaaacaaaaaaccggaatgcaagtcaatgagattcttatgttaaaagcagaaacaaatacattgattattcattgaagcagcctttcaactttaatgacattatcagcactttatctgtgcatgaggttcaagttccatcattaaccagcatccataggatcctacttattcttaaaattcacatcctctagggaagggactctgtattctacagcacagatttgaggtgcaggcaatttaattaccttctatttgagcatttgattttattcatgtttctatctgtctgagtgtgatatccaggtttttcacttttctctgttgttaaattaaagattttaggtagatttaatttcattttctgataaatgtctgtcagaaacattggaatatttttatgaccaatagtgaaactgcaagctggatcaagttttatttatttatcagtttataaaaacttttaacatagactcagaaaattgaactaaatcctgattataaacatccaggaatagcaaatttgggttttctttctgcctttctttttgactacgttgcaagaacaatatttgaaaccaatgggatttattttaattgtagaagactggtaatttttatgtaagtttcatatcatgtaatattaataccaagcatactgcattttatgtttgtgcaatggtgttagaacctgcatgacattaaaaaaattttaagaataaggatttattgtttttaatctgtaaataatactcttatcacatcaataatgttttatcttgaaaataatagactgtaaatttctgactttgaaataccataaatatacacaactttaaaatgccataaatatacatgccataaatatacacaactttaaaagtattacaaatataatacgcaaaaagaactactttttagtaccatgtttctgagatttttggtttcaactaaaaaattaaaatatatgtcagcaaaaactgtgattacattatttctttcctcatttcctatcttcctccttcttttcctccctctctttctcccttccttcctttctttcataggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggttgcagtgagctgagatcacgccattgcactccagcctggcgacatagagagactccatctcaaaaaaaaaaaaaaaaaaaaaaaaaaaaaggccgggcgcagtggctcatgcctgtaatcccagcactttgggaggccgaggcgggcggatcacgaggtcatgagtttgagaccagcttggccaatatggtgaaaccccgtctctactaaaaaaaatacaaaaattagccaggtgtggtggcgcatgcttgtagtcccagctgcttgagagcctgaggcaggagaatcacttgaacctgggaggcggaggttgcagtgagccgagatcacgccactgcgctccagcctgggcaacagagtgagacttcgtctcaaaaaaaaaaaaaaaaaaggaaagaaagtcttcattacccttcatgtatgagtctcttctcaaggatcttttgagtggtctattgaattaagggccaatcctccagcctgtgcacacagtttgatagtaatgtgagctcttaatatcaggaaattacaaaggggaacagattcctatttattggctgtagtagatcaagatgtacttttcatccataccacctattctctgcctgctttactgccagaccaccaatctggtcacaggcaggattctgtcatgggtctgggtgttacatcccacaatgggtttatctggtgagggatttatattacccactgttatgctagtctgttgtgacttatgtagaaaaaaacaccacagtcaccccccacccagctcatgtatttctctatatttcttctctcttacttctcattggctgtttacttccaagacttgaaagaaggaacccaattattattgattcagccacaaagagagagagagaaaaaaaggctaattaatcatgaaaactaagtatttgtgcagccatatttggtacctagtactaaattatcactacatcttaagtataaaacactataaattccatcataattgttattacatgataactatgacataatattatgaccttacctttcaaaagaaattccaaggtatgaattagccataaaaatatttagataatccccatatactcagcaacttttccggccccatatgtcaccattcccttcatttaatcacttataggttgtcagtaattcacatagatcacttttaattaataaaccaattgctgaaatgcccattgtctactgtcctgtggatggaaggctagactgacagcttgcctgcaagggctggacttcctgatgctccaaaattgaaatataacaaataaggatttggctattgaatttcaatttcataagaaaatgggacctgtaagagggagagaacaaactttcactgtagcccaatgagctcgtccttggaaaaaaaatgggcagctgtgtttgtaaggagtgttggattggcaaaagagtaactgtgaatatctctcaagcagcagaaaattacacatgaatatgtaatttattttttataaaatgtctcttagcttataagtttagattacaagttcagcatttagtattcaaatcttcaattgatgaaacttcacaataacgtttttcatcaaacttctggacttgggcactggacagtgtgtttataatctacttttactgttagagaaaatgaagacctacactagtattcataaataatttttgttcattttattgtaactgcggtcataaactctagtgttttaaacctagtgttaagcacacttgttctgggaaataatatcgttacagctacaaattttcaatttgtcttagagtctaaagggaagatttaggttacccaattcctactgtattgttgaatatgtaaagcatgcgtgcttgagctttaattcattagatgtccatggctattttgattgttgatgataatagtagctgcatgatgctcagccctttgtgacttttttccttgcttatatcctgtctttcctatcacaaaagtttcttggtaacatgaagtttatcttttaaccttaataagatatacaatattgtgcacacaataaacattctgttagcattattcggtgacacagattagattcacagctgaggtacattgagaaaagactgttagtataaatccatcaaaattaacaagctgttcacaagggcaatgtggttaagtataccaaagccctgagaatagcagagacccatggaaatctacttgtgaaacctaaactaaaatgttacatctatggaatcaaagaagacttatataatggattttctctatttttttcttactaaatttcactggtccctgaggagtggtatgaacagtttggagtcaaaataccctaattagactccaggctcctcatctccagatatatgtatatatctggccctcagatttctatgagtttctatgaggcttaaataagataaggtatatgtaagaactgacacacaatagaagctcatttcagtttgttttaaatctgtgctgttgacatcaatgcaaatctcatgaagaaaacaaaacaagattgtattgcatgttaagcttctatccgtgttgaaagtggaaagcattgtgttatattttctgtttgtatagcggatggatgatataggttcaatgagaactttgcttcacagagtcaacatatgtacttcacttatactagatctgttaataaggacttgtatgcaaaataaatagttctggtaaatcaatgtattgaatctcctctctttatctcagattaataaaaaccacttttaaattttgactcgctaaagtaggtacaccataattcagaggacagtttaggtctgtattatgtgaggagcctgattgtagtaacaaagatcccgccaagtctcagtttcttcatatggtaaatgtgcatttcttcttcacgcaggaatcctgcaccagcgtgcccagttggctgatgcttatggacacctcttattcagctggcagctctcaggccctagactctgtccatcttggggttatgtcctcttctaggtcctgggcctcctctctattcacctgccaaatggaaaagtagaggatgtggggtcttgtgtgggtgtttatggcaagagtattagcagcataaatcatttctgcctctattctctgggtcagaattcagtcacatgctctacctaattgcaagagaagacaggaaatgccaactagttgagcatctaggaatagaaagtgggatttggtaaaaaaaatttttctgccacatgataattacatgtaacattctaaattataaaactgcagtcattgtaaacagaaataagattctacttgtttatcctgctctttttgtttttttttttgtttggccttactgaattttcttctttcaggtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgaggtatagtcagcattagcactcctgtaatttttccccaatttgtctttgattttctttttcctttttattgtaaattcagggagcacatgtgcaggtttgttacatgggtatattgcataatgctggggtttgggcttctagtgagcccataacccaaatagtgaatatagtacccaataggtagtttttcaacccacaccccactcctaccctgctgcctcaagtagtccccagtgtctgttgtttccatctttatgtccatgtgtatccattgtctggctcctacttataagtgagaacacatggtatttgattttctgtttctgcattaattcacttaggataatggctcctaattgcatctatgttgcttcaaaggacatgatttaattattttatatgactgtgtagtattccatggtgtatatctataacattttctttatccagttcactgttgatggacactaaagttgattccatacccttcctattgggaataggttgactgatgtctgatgttgagtggaagcacctgccctggtgtgggctgcagggagggaaggatggtaaaaagcgatcatgttggaatgtattggggtctcttggggagtgataagggggtgtaccaacttctagtcctgagccagcaggaatgaagtttgcttccctctcgtgcccgtgttgcaggactcatgactcaattcataaagactttgtcctttggctctgcagtgcagctgcaggccacagatatgcccctctaggagctgttaccaaaatgggctcagggcaaggcctcttccccaactccagggcaagcaacttcacaacttgtctgtccgccattgctgggacactgctgctctgtctaaaggcggggagttgggccctgttcttcctgtaagcccaagtggcacaagcttactttcagcagggattgagccactgaaaaaagcacacacaaaaaatgctttctttgtgtgtatgcactaagtaccagtgggaagaaccacagctgtgtctgcaacagtctagagtgggagatgactccctctctacgactgtccctaggcattggtgctgcccccttcagtgactggccccatgcctgcatttcctttgtcccaaggggactttgatgggctgtgctccccctcccttatgggcagcctacactgtgggtttagatcttcagaagtcctttagccccctgggacccacctgtcccccatgcttcccaacgtcagagccagttgtggggtatatttgcaggagatctggtggtacagtgactctagagcagagagatctcaggcagggcagtggcactatgggtacacaaccagtatggcaccctccatctcattttgggtctgagggaaacataggtgtgcctgcacaagctagcaacctggttctctgtccctgggaagttcctgaatagccacttatagcattgtcttgggtcactagcacagaggggctccttagaagcttggcagtcaggagattgtcagaggagtgaggggaggagagaagcactcccacctactttccatggggctccaagctccttgggggtcaatctctgtggactcttgctgcttcccttttctacaccctgcttcttcccactggccctctgacagatcctggctctcttcccccagttttctgttcagaactgggcctttcaccagtaactttgatcatcttcctgaggagaactggcacctgatgtccctagagagccatctgctcgaggcactgggcactgtgcactgtgctgtcactgctgaggggaatggtgactgtagtcaccctgtgtggccacacctcgagagctgtctttgattttcttttgcatagtattacttgtaaattcatgtgataatatttactatgtctgggatttttttggaaatccatatgcatgatggggggaaaaatcacagaccacacacacacacacacacacacacacacacacacacacacaaactctagatatctgaaatcaaattttttttgaagtttttattgctacataattgatatacgtattttcagagtacatgtgataatttgatgcattcatataatcaaatcagagtaattgagatatccatcaccttaaatattttttctttatggtaggaacagtctaattattctgcagctgttttgaaatgtacaatagattattgttacctatgtcaaattctttttttttgtttgtttgtttttggagacaaggggtcttattctgtcacccaggcagtaatgcagtgatgcgatcatagctcactgaagcttcgacctcccggctcaagcaacatttccaccttagcctcatgagtaactgggactacaggcatgtgccaccatgcctggctgtttttttttttaattttttaaaaatttattttattttattttaattaattagttttttgagacagagtcttgctctgtcacccaggctggagtgcagtggcgcgatctctgctcactgcaagctccacctcccgggtttacgccattctcctgcctcagcctcccgagtagctgggactacaggcgcccgccaccacacctggctaattttttgtattttttagtgagacagggtttcactgtgttagccaggatggtcttgatctcctgacctcatgatccgcccgccttggcctcccaaagtgctgggattacaggcgtgagccactgtgtctgatctatagtcaaatttttaagttcagattctgcccctgttttcccatcaaaactacccctctctcacatttttcctcttctgattgaaggcaaagccaatcaaccacgctggatgtctggatatcatccccagctgcaccctttctgtaatcgttacatgtatttggttaccaagtctagtcagttttccctttaagtgtgctttctgactattctgactgtggagaacttctatactgactcaaaatactgatggtgtaacataataagacaatgtcaaacttacaaaaacttgtagtttttaacatccatgtacactttgaaaaaaaattaaggaagtatttcagccaatcaaaaaactgaaacacaataagtagtttgagaataacaagcatattacagtccatctttatgtgtctcagcctcccacagtgataagaagtgaaggcgcaaggtcctatctactttgaagggggaacataatcttttggcccatggagttggtttctgtaacttgtaagaatgactccccttttcaaagtttggtcggacatttacagatctgtttctttatgtcttcatcagcatgagcctgagaaccttggctggagtatcaaccaacccactgtaggatgcgatttttctggttgcctgtgtgcactcaagtttcttcctcctctttcccttctttggctagttttaataatcaaaagaaggtggggaagcagcatatggggcccagttaagctgagcacagagttgtttttaatgaataattccaacctaaccacaggacagtggtatttaccagtcaaactcctaagtctttttctggaagggaggatggggaggtggaagagacaatctgattataaaatatacatggaaatacaaaatgccaagaatagccagcaactcacaaagaagaatatggagggtggccctacttagccaatgtgtcagataatacacagttaaagtaaataaggcagtgtgatatttgctctgggatgaacaaacaggccagagagaagaaaatagtccagatttgtcagtcgttttatagtttttgcttttagaatcatgtttgattctaaacagctttcttaatacctaaacagctttcttaaattaataaagatgaaaccagaatgcaattaattaaaaaacaaaaataccaataaaacctgattcataaattaaaaaacttagaaaataagaattgacgagaaggaaataattattaaaagagaaaatattgaaaattgtaagagactatataaatgtcgacaaataaattttaaaaacctatgtgaaattggctctagcagatatacagcagatatagaaagtctaaacctatgcacttttgaaaatgaatggagaataaacattaaaaacattaaaagctcagtaggtggttttccaaaggaattccaccaaatatgtttacatggtccatgtcttactttttttttttttttcagtctaatgactcttcttcagagccttcaacatgagatagcacagaaacgaataccttttttcccttcggtattgcaatatgtgattaaggaagtcatcagtgatgccctctggcagtctatttgccatgcacatgttctgccatcattcttgaggtgtgattaccctaatggtattaaatctcaatcaagatgttgcaggaatatcatccgtttacttctcagcttctgacacatgatgactcatgaaacatctaggttgtgtgccctagccatgatctgaaaacctctcacctgaggagcatttagaatttagaaattagtttcaaatgtctataaagattttcctcagtaataagaagcaataatttcccagttaccagattcttactgctagatacacttcccaggtgattaaaaaggttttcttgttttgagcataaaatctacattaaaatggcaaatagtctgatcttttcttccagcgaataagttcatccatttttagagtactgcattaggaggcatggggttgtttctagattccactctctccatctgcttgtttggtcatcagcctggtacatttcatgtacaactgtgtaacggctccattgtttttatatgtctagttctgaatatatacaaagatctatgtctcccacgggttctaatttggttttgaggatgtctttcatcatctctcagttctacttatggctagtggtatccactccatcaataatgcccaggtggaaatcgttctcatagcaacttagtattcacattggcaataaggaaacctagtctacagaagctgttatacctacggtacatcccaggttgtaccaatacttactgtataatagtttcctggactttctcaaaatgtagcagtgactgtggagtcaccattgcccatcttacagggaaattctcacaataattctgttcagtcctaccttggtaacagggcaaagtccttctttcctatttctactttatgcaggacaactaagctccatactttgtttatagaaacatacaactctccggaactgatgaatggtctataggtgatgagtcagggggatattgcactttaccttccttggggagaaaattatgaggtggagattcgtgtccagaggctttttaggaagtgctcttgaggtcaacacctgtgtaagtgaaagaagcaagattgggcagggatgaaggcaaagcatgaggcagttgaaactgatgctacagtatactacagtttgttttgaaatgggactgacccttcagagctgtctgagttagaatgatggtgagttttataatcttgtgttgagcagtcattgtgtatggaccatgccaggaagagcatttgaccatgtgagaaggggttgtcttcagatgagacaatttgcaaaggagcctgtcagatgagggtaataagtcctttccagaaggggaatcttagtgaacatcagagcatccaccactgagatgcagggtacagccacgttcaagagaagtttgttctgaaaagctctccctctctttcccttggtcttttatgatataccttattttttcactgcccactttgactctttgccttctacccattcctgtttccttcctgccccatccactgttgttggtcccaagagtactccctattatgtctttcctctcttgtctttctcttagcagagtaacttctagaaactttgttaagtatcactgtaggctggtaaaaataaaatggtcctgggaagataagaggaaagaaatatacagagaacaactatgccaatactttgagagagaatcatgatgcatatcatttttatctctaccttttcctctgcattctaaaacaacttgaatttgtcctatgcatcactgattaaattttctgcagtttgaattctgtattttattgtttctcatgaacattgtagttttgcaattgcattttttctttgagatttttattattaaatagtattattttaatctcttcactcaagcttttgtttcttcatagttgcttattgttatttttaaaatatatacatttaaaaaattttgtaagggcttctaggaaaatatgtgctccctgcctgagacctcattagatgtacttatgaaaaatctgtaattctgggatgcagtgcatcattcccattccttttactctctacatattacgaattggaaactcagaattgatataaagatgaaagagctgataacagtgggaacactaaagctctgaggtaggtggcagccagttattcttggttagtgtagtctctgtggcctggagttcaaagaagtcaggaaatgggtcttacccccagtattagtttgttctcacactgctaataaagacatactcaagactgggtaatttataaaggaaaggaggtttaatggactcacagttccacatggctggagaggcctcacaattatggcagaagatgaaggaggagcaaaggcatgtcttacatggccacaggcaagagagcgtgtgtaggggaatggtcctttataaaaccatcaaatcttgtgagtcttactcattatcatgagaacaccactggaaaaaacccacccccatgattcaacacctcccgccaggtccctcccatgacgtggggattatgggagctacaattcaagatgagatttgggtggggacacagccaaaccttaacacccactttgtggtacttcttgttatttaggttcatggcgtggaatgtgtatcctctagtctactccaaactgattccttcattagtgaaattttacctgtattttagaaagattttaatctttagtttctttctttctgttagtcttggccctttatggtgtctacatgtgcatttgaagaaggcacaactcatgcaaccagtctctgccagtttaactcagaagtctctttcctacatctttgttttaatttgctgtaaaaatatatgtgctcatggaaaacaaacaaacaaacaaacaaacaaaaacaaaaaaacctcagtcagtacagaaggatgtagaaaaatgagtaaaattcccctgactccttctgaatcttatattcctacttcccagaggtaaccgctattgacagttttttatataccctttgaaaaatttttatgcgtatccaaacatatgtgtcttattcttacacaaatggaattttacactgcaatctgttcagtaacttgctctttttactttataatctatcttaaacatttctttttcatactagctaaaatccattgcactaaaaaaattggttacatatttttcattgcatagattccccttagtatttgatactattgacatttcttcatgagcactgttttactgtggtgtttatagttctcttacattttttatatctttctgggattcacatttcttgtttagtatttagttctgtctagttctcctttcccaaatgtttatatacttttgcagacttccatcacctatatttgtattattttcctctcctttactatcttcgcaatcttggttctcttgagatatgggaagtagccactgaaaagtaaaaaggatatagattttatagccagctagaccttaatccaaatcttcactctactgtttaatgccatgtgactttaggaaaattaatttctctcacatttgggttctttgttgcaaaatgaggataataaggcttaatctaaacaaaggctctgagtattgcatgaaataatgtttgtgaagaaactaaccaatttacagacatttagaaagtgttttatacaacaactgtaatttagaaacattttaatgaaatagcaggttgctacctcaacttaatatctacatcataggataaaaattaaaggctttaaatttttaaaattcaacaccttttctacatcatagaataaaaaattaaaggttttaaattttttaaaaacaggaaaaatttatatttctattttcctgagatagcctatatatagtaccatttctcaaactgttgctctgcactgctattcagcagaatagaaataattgttctgaattttaaagaaagaaagggattccaggttcacatggacttgggaaaaccttgattgagctaagtaggctctttctatgcaggattatttttagacactttaatatactgaattccattttgaatctctaatattcggaatttattcccctatgaaacttccccatcacctttttatcccagaacatttattactatctttcgtaaccattggctgggattttccacctgtaatcacccttttcccccctcttactggttgtagatttctttgagaaatgaagagcatatgatatgaagagctgccttacatatacagtagataaggtggaaggcaatataaacatataaaatatagttgattctcatgattcacagtagccaatccttatcattcacaatcccctacttgtgaatttccctactcactaaggtgtatttgcaacctccaaagtcgatacttctggtgttttcatggtcattcagggacatacagaaagtgttggagaatttgattcacctgatttgtgcatttccagccgaggttgaagaagccaacaccttgactttgtttcagctctcatgttgtaaacaaatgttctttttccagtccatttattatcacttttttaaatttttgtgctttctgttggtgagttttctgtttaaatttgcccccaagtatagtgctgaaatatggcgttcctaagcacaagaaggctgtgatgtaccctaagtagaaaatatgtatgttagatgaactttattcaggtgtgagtcatagtgcttattaaacatgagaaatgtatttgaatgattctaagtttttgccaatatgtacatgtctgcaaattaccacaaaagtgctcaatattgattttggggttacaaagttggatgagtagacaaatgtgcaaataaggaatccaagaatagaggaaccaactgtatataaaatcagtagcaccttggagaaattactgtacatataaagaagtatgtaaagatgtttatggcaatattatttgtaatagtaaatagccattgtcagataaatcttgcaaatagtataaaggcaaacaatggaatccccacagcaatgaaaataatacattgagtctgatagcggtggctcatgcctgtaatcccagcattttgggaagccagagcctggtggatcatttgaggacaggagtttgagaccagcctggccaacatggcaaacccccgtctctactaaaaacacaaaaattagctgagcatggttaacgcacacctgtaatcctagctattcgggagactgaggcaggagaatagtttgaacctgggaggcagaggttgcagtgagctgagatcgtaccactgcactccagcctgggtgacagagtgagaccctgtctcaaaaaaaaaaaaaaaatacattgagtctacataagaaaacatgggtaacctcaacagtgtgcattgaaggaaaaattaaggagacacagtgcattttagagtgaataatatgatgggaagagttttgcaaagggagatcgaaatgggctaataaatgggtcaaaaagaataaattataataaaagaccatttgttgtccagtagaaacaatgctgttgaccgaagtaggaccaattcaaactatgcacctgagatccaagaaaaaaaataagaaaaaataaaatcattaacattcttatgagttaccagtaatgagaaacaatgtactatgagaaagaagtataaaatacctaggaatagattcagcaagaaacaagtggaactgatatgagtaaagataaaaacaaaatcttaaaggtgaaggtaaaagaaaactgaaacatgcatataaaagaccaaggtcttagacagaaaaactacattttcttgtgaattaggccctttactgctgcctttagatatttttgttaactagaagctgccattactaatttaacatcagcaaaatataccatgaattggatatccagtgttgatgaacaacggctggcatctcagggctgtggttgcccctacaactgtgatctaatgtcattcacactttgttttctcctttgaatggagctgtttcttataaagtctatgacctttgtctgtttacatcattgtgtgatcatttggctttctttaaagattggattttcaacggttaacatttttcagtaaatttaggggttgtattcttttcccattttccccataaagaacctaagtggaatttgtattcagaactgatttttgtggagtaattctttctagctgcaactcgtaattctagtgacaaaaaagacacccttaaaaatgattatggacataaacgttattctgctaatgacaacattcaaactttggctttggtcaatctggaaaatgcactgtttctgtcattggatgtagactgagtcccagaagaccattgtgttgcacacacttcaagacacagtgttggaggaggacaggcgtttcaccattcagctgatatcaattgatgaggtagaaatatctccagtaaaaggtaagagaaattcacatttttggaaattaaaaagtaaattctcagaaaaaatgtaataaaaataacccgtagttacaaaaatggacagggttaggtttcataattcctaaaacataaagataccattttccacatgtattaaaggttaagaattttttaaattaaaattataatacccaatcttggtaaggtcataggtcaaagatttcatacagcttagctgtgtaatttttttctaatgaagatgtttattgtagcagtgtttataaaatgtaaaataaaatatgtcagcttcctaaatggtccaacagtaggagactagttaaatgtgtcagaatactaggcagccattcaacgtgacataacaggaaaaactctcaattacattaaaaattaagaacacataattacatggataattgtcacgttaagaaaacaggttttgcaacaacatgctaaatgtaatctgttttgtcatgtgcatgtcttacatgaggttggaattatttatttgaaatgttaatagtggtttttgattacctatattttctaaacatatttacaattatcacactttacctttgtaataaaacattatttttaaatgtgtcatattatgtttagcattatagcctatgtacgtctgttttcatctgaaagtagttactcaaatattttgacacttcagaaacaggcattttaattctcatttgcctccagttgatatgatgatttgttttttggatccatagagaaaagagtaatgattctaaaatggttttattgtgctataaacaataataaccaaccataaaaaactggttcagaaacttttagcatgaaaatttggtgattaatacatttcttttttgccatcaagaactccatcctatgtgactaaaagcagatttaatgtccaaggaaatttttagaattgtagagtatctatcactgtgtatacttagggtagttataatttctgcattttatttaggatattttccattaagggaatgacatcactgcaccatattcttttataagtctttagttagctttagttaactctttcataagtctttagttatctacatcatgttaaaatgacagatgtcacataggctaattaaacatagaagaatatatgattggatcaggataaatcatttaccatatcaaaaaaatttttttgaggcagggtcttgctctgtcacccaggctgcagtgcagtggtgtgatcacagattcctgcagccttgaattcccaggctcaaacaaacctcccacctcagcctcctgagtagctaggactacaggcatgtggcactatgcccagttaatttatttttatgtttgcagggatggagtctccctatgttgcccaggctggtcttgaactcctgagctcatgggatcctcccacctcagcctcccaaagtgttgggattacaggtatgatccactgcacctaattcttaatatctttctgtctgactgtgacacttgctgtgacaagccactcttgattccattaatccattgccaaagaaagtgagagtatagtgatacagctctttgtgtcatgaacccctaatatgtgtttctggaaacaattttctttaagtttctgctaagttatatggatactcaaatacttgatatagttttctatttccatcttaatagaaatatttgacacaggtttataaatgcttacagtcaaatgatagagtcagaaaattaaaaatgaaaaagtgcccccaagaaatcttgcttttgccatatagccagttgacatagctatgtagtcaattgcagtgagctgcaaaatggttactgtagaaacaaattaatgccaatggtagaggagcccttgcttttcatgagcatgatagggcaattactgccaatttttttttctgcccctttcattaaaatgtaatcttgggcaagcgatttgcctccatgtcttcaagacctcaatgtgcttcagagtcataggtaaaatgaggatattaataccttactgatatgagagtcatgagaatgaactagattcctgtgtgtaaagtgcttagaaagtttccaggcatatactaagtgcttatgtgcacctgctacaaagtggtctatatcatcttgaatttaggtagtgcatcaataattattcggggtgataagcgagcatcaggagaagttgggatagctccgtcatctaggcacatcctcattggggaaccctcagcaaaatataatggtaccgctattatcaggtaaggacttcatgatttttctttgcctatatgggggttacgaagttttatttaaatcattagtcttaagtttatcattctcaatacatacatagtcttcaagcattaacattctatatactgttaacatcctgtggagaggagaacaaatttggggcagaaattggaataatatcctgacctatcttgatattagatcatgagaaggtttctgactcttgagtgatttgcacaaattacaccaaggaaagcacatggagttgagatcagaaaatctatgttttcacctctgttctgttactaaacatgtgatataagggagttatttcatctctgcaagcttgtgtgtcttagctacaaaatcattccttagaacatcatcagggccaaacattttgctttcaagtgttctaaaatcagagtctgtattagtctgttctcacactgctataaagaactgcttgagactgaataatttatgaagaaaagaggtttaattggttcaaggttctgcaggctgtacaggaagcatggctggggaggcctcaggaaacttacaattatggcagaaggcgaaaggagagctgacgtgtcctacctggctggagcaggtggaaggggtggaggggtgctatgtacttttcaacaaccagatcttgtgagaactctatcaggaaaacagcaagggggaagtccatccccatgattcagtcacctcccaccaggccccacctccaacacttgaggtcacacttcaacatgagatttatgtggggacacagagccaaaccatatcagggcctatcatataactaaattagtatgatcataggcaagtttgtttctggtaaattttcttatgggggatgggaagcaactatcaatggcatagctgggtttgactttatactttatcctcatggtagttatccagaagtaagactatcccttcccatcagcatgcccttatatgaagggtcttccagtctttagagaacttagacttttcatattttgtaccttgcgtgttaagtgaaaagcctataaatattaatacttctttttatttctttaaaccttctgcttttagtaatcagtttttgcttgtattcctgtcaagatagatttacactagcttaatactttgggtgttactatcttggaactttaagacttcctttggtttatagtttggtaaatgaggttatttaaaagaaaactgttattgaaatggatgaaaattgattactgttaaaagacagagaaaatgtttaagaaaagtaccttcaactgaaatgtattggatatacatttgtttattgttgtagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggtatcaatattagctggtttcttttatgccctttactctctgtgctggtgtgtgcacatgtgtgagcatatgtgtatgtgtgggtgtgtttgtgtgtgtgtggttagaagtgggggatggggaggaggtaaatattacagcatttgtggttggcgtgcacgtgtgtgtgtgtgtgtggtgtgtgtgtgtacggttgacaatggagattggggagaaggttaatgtaacagcatttggtattgtggaggtgcctgtgtatgggattaagagtgggaatgaggaggagattaatattacaaaatctgttgttattatttagaggttaggagtttttcttgaaattccacagattctactgttgatgactctttgtctttttctaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggtatagtatgaaatgcttaagattttaatatcatttttatttttagatatgaaaatgttttcttgtttctattccagagttttcataaactgattaatttgctccaaacatcattattttaacatataatctatataattttataaccttatatgtaattttaacacaatcctggtaaatagaacgtttagttacagacagtattgtctggtagattaaacatccaaatcaaataagaaaatgcattttgcataggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaaggtaaaggagaaaggcaattaggaaaaagaaagcaaagagcagagagaaagagagaaagttctattgtgtagagattaatactgagctctaaagcagttctttccctactctttctcagatttgtgtgacattagaacaggacatacaagggaaattatgacaatgactgagtttttttttttaattttgttaaatataacttccctctgaaaattgaaagtatgtgtttctattgtgtggactcactctgggtagccaggaagttgaatatgataacggcttctaattggtgaagacacagcctaacagctctctaaatcagaggtcagctggtgtggctgaatttgcttcttttgatttccatacttgtgaaagggctgaagggagggatttctttcattggtgcatctgaagtctgtatcgtcttctctgtgggtgaatgacatagatgcttgccccatagttttaaagtggggaaaaatttgagtgaaagctagttggccattaatgtgcaccatgttttcaaggaagataatgaattaaccttaatgagtctctttcattccctgatttagtgaggcagatttgatgaggtggaaaaacatctttagcatgtttaagtactcacaggttctgcagctcacaggttgagagagacctaccagcatctctgcccagatagcagataggtgggcccttcaactagagtaatgcctgcatttagaagaatcataaagacatttttcttgtgcatgaaaatatttttgcctttgtaatgtgaatatcatgctttaaaaactttttaaactaaaatatgttactcagtgacttaagtgtatatcatcccatctgggaaaaaaatattgtgggctcacatacccttcaaattttagatttcccaaaaatgcttctatgcctggcaatgagagtgaatttgtactcctagtaaatatagtaaaaagtttgagctgatcactgactattttaattaaataaatgcaatttggtaaaagtagtcgtttagtgtgagatcatatttgtgttactgaccagctagagcttgaggattttgtcttctttgctactgtttttttaaaaagcagtttctatgtaagtttaattctggggaaacaagtttttccttccagataaatttctaggttttctttgatctcaaaaggtaagtagtacaattagctaatctacagcccatctcagactactggtaacagttactcttatcatttaatattctaaatctcaattttctaattttgccttttatataattcgccaactttcaacctttcaactctaggtagggtataaataccagaatagaatttgggaattgaaggaaggactaaaatggtttatcggcattttttagcatgaggaattaaagtcatattttaaagccttggaagttgaagctttgtttgatgggaataatattaatctaaaaaaagacttcttttgcagaagtatcattacagaagtaaactaccatctatattaaggatagaggaattgattatgattggtttctgtagaaattgaaatacttttctttcttttttatttttctttctttctttttctttctttccctttttctttctttccaaagtcttgctgtgtcacccaggacagagtgcagtggcacaatcatagctcactgcaactttgaatgcctggactaaagggatcctctcacctcatacttctaaatagctatgactgcaggcatgtgccatcatgtctggctaattttttaaaattagtttttagtagagacaaggtctcactcactatgttgcccaggttggtattgagagatatttcttttgaatcttgatgatttagtttgaaatttaattagtgtcatgacactcactatttctttgaataaatcatcttaacctaacactgtaaatctcaaggccgcctgcttacttacctatctctgagtgcactaggtctattactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaaggtaggttcagtcagctagcttgtaagtaagtttactaccactttccaaattacattagtttgaatttccgtgtgtaaattgttttagtttggtgtgggtgtgtgtgtttgtgtttacacatatacacttttatatttatttacttatttgaaatacattttcagttatctttgggtagtcttgaaccttactgtgaatggcaatgttaggaacaagcctgtctagaaaaactatgtttaacattaggattattaaaatgtttctgtttcaaacattttaatgaaagcctttgtaatttgtgcatatttaatttcctatgtgactagaaatcagtgaatattcacttcctaatgaataatcatctttgaaatgaatattttactggcctagagatgcaggtagtatctggatccttgatcttgctttctcgaaacagtccccagtagcagcttgcctaatattgccaattctttcctcttgtagaagcagaatacagaatatatggttatattccttcccaggtaggaagagatggctgcctttctaggaaatgattttattcaaaggcagaatatgaatatgactttaaaaataaatatcttactgctgcatttaacctgattggcttcattgcctctatcaaaattctttggttatctagccatttttaaagttcataaaaaattgctttaggagttggtttataatgagtttatgggtaagttgtggaatacatcactattttgtgaacttcaatctgtacctggaaaaaatcatattacatttttgcattaagaaataaatgagacttggaattttttcagttcattgttttctgttagattcattatctttgggaattttggtcagtgtatatttatatttataatatacattgagtattatttagccatagctaatgtgagccctattaaattatattttaatatgcagaatttagcatagcttaagaaatatatttttgaaaataatgtttaagttgaaatcaaacattgaagacacattttcagattcacaagtagatttcataggaactgaaaatgtaatcaaattgtacttgtatctggacttttaaaaattcatatgatatacatatcataaacctcatttatttatattaccatatttatatttcaattgaatgtgtggaagcaatccagagtggtttcctatgagcacaaacaacttaaatgtttttttgtatccatctaacattgtcttagaaagcaaggatcatttgtttttatgtagtacacagggagaatgccaatgctactgattaaatacattgtttaaatgctaattgtactgttctctgtaactttcaacatctgataaactatgttcctcctaaaaaatgtcatgaggttttcactaatccccctttaaaatgataaaagaactatgaaaacatagagtgcttactttgtgccattatgtttaattgccaggtttaatttggctgaatcttataagttagttgctctgtctggcttaccaattaattccaagttcccattacagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaaggttggtatatagaaaataatgtgggcacatataagacataagtattgtgttcaaactcttacatatgttttgcactgacaatagaactttagataatatgtgtccattggaaaacaacaggtgaaatacttttggggtactaggggtagggaaagaggggctaggagacgatgtggttgcatatgtcacttcatttcaaataaaggaaataatattttctgtttctctagacttaaataatctaatcagaatgtggaaacattctttaattcactttctttatgcattaagcaattaaaaagagggcaagaaagtccctacaactgccctaggtcatgtaatattgatgttaatcattcattcttttagctaagcacccacttcttaccacttgatgtgtgactactgtgccttgaatatgtatgaccaatttggaaaatgactggttattgggattttacaagcactttaatatgtttagactcacagaattgctccttcttgccatgcagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtagatttatgttccccatgactttaaatataatttttgatagactgagtatggtagtgtgttttctcattgcccaagtatatttctttattcacagccaatcaatatttattaattatcttgtatgtgtacagcagcttttgagccagattaagtacataaaaatgtataaggcatacatctgtcctcagggaaccttgagggcttgttagaaatgaagtgaatgattctgataaaattcattaattcaacaagtatttgttgagtgctttctgtgtgtcacacactgttctaggtactgagaatatactgaggaactagatagacctcatctccgttcttacagagttttcattttattaagcagagctgagcaataaacaactaaaaataaattgatctgataacagtaagggctctgcttgtaaaattgggagacacaattgcgagtgctgttggtgaggatgtgatatttcagctgaaagatgcattaggagaaagaggttagaagggtgagcatttgggcagaaggaacaatagcttctgcagaggcataagctggcatgtttcaggcatggaggggttcatgtggtcggggcctggagttaaggggataacagcacaggatagaccagagggcccaatagatgttcgatcacatggaacctcctaagccaggttaaagatgtccattgctcaatgaaataaaagaggacacaaacaaatggaagaacattccatgctcatggataggaagaatcaatatagtgaaaatggccatactgcctaaggtaatttataaattaaatgccatccccatcaagctaccaatgactttcttcaaggaattggaaaaaactactttaaacttcatatggaaccaaaaaagagcccacattgtcaagacaatcctaagcaaaaataacaaagctggaggcatcatgctacctgacttcaaactgtactacaaggctacagtaaccaaaacagcgtggtactggtaccaaaacagatatatagaccaatggaacagaacagaggcctcaaaaataacaccacacatctacaacaaacctgacaaaaacaagcaatggggaaaggattccctatttaataaatggtgttgggaaaactggctagccatatgtagaaagccgaaactggatcccttccttacaccttagacaaaaattaattcaagatggattaaagacttaaatgttagacctaaaaccataaaaaccctaggagaaaacctaggcaataccattcaggacataggcgtgggcaaggacttcatgtctaaaacaccaaaagcaatggcaacaaaagccaaaattgacaaatgggatctaattaaactaaagagcttctgcaaggcaaaacagactaccatcagagtgaacaggcaacctacagaatgggagaaaatttttgcaatctatccatctgacaaagggctaatatccagaatctacaaagaactcaaacaaatttacaagagaaaaacaaccccatcaaaaagtggtcaaaggatatgagcagacatttctcaaaagaagacatttatgcagccaacagacacctgaaaaaatgccgtcatccctggtcatcagagaaatgcaaatcaaaaccacaatgagataccatctcactccagttagaatggcgatcattaaaaagtcaggaaacaacagatgctggagaggatgtggagaaataggaacgcttttacactgctggtaggagtgtaaatgagttcaaccattatggaagacagtgtggcgattcctcaaggatctagaactagaaataccatttgacccagccatcccattactgggtatatacccaaaggattataaatcatgctgctataaagacacatgcacacgtatttttattgcggcactgttgacagtagcaaaaacttggaaccaacccaaatgtccatcaatgatagactggattaggaaaatgtggcacatatacaccatggaatactatgcagccataaaaaggatgagttcatgtcctttgcagggacatggatgaagctggaaaccatcattctcagcaaactaacacaaggatggaaaaccaagcactgcattttctcacttataggtgggaattgaacaatgaaaacacttggacacagggcagggaacatcatacactggggcctattggggggtggggggctaggggagagataacattaggagaaatacctaatgtaaatgacgagttgatgggtgcagcaaaccaacatagtacatgtatacctatgtgtcaaacctgcacgttgtgcacatgtacccttgaacttaaagtataataataaataaaagatttcattctaagtgcaaataggatgccattagaaaatcgtaagccagagaacaatgtcaccagattgtcttttaaagcagctcatttaagtctagtgcaaggaaaatggattcaagaagctggtggggcagcataggagcaggaaggatggctaggaggctgtttatttccctctactctccatgtcaaagctgatggtggctcagacaaggtggtggaaataaagatggcgagaagtgggtatacattgatatttggaagaaaaattcattgggctagaagtagaggctgagggaaagacaggaatcaaggataactccttgaatttaagtttgagcagctggataatttgtagggttgtttactaagatgcagaagctcaaggagaaattaagagttctgttttgggcgtgttcttctgagatactactgacatcccaggggagggtggtcacataggcagggcagcatgcgactgtgtgttgtggggtggtcagggctgcagatgcaggtctggaagatgttgacacatggggaggtgtttgaacacgtggggcctaaggggcatatctggaaacaggaaggatatggtgctgagtcctgagcttccaccatttagagatcagaggaaggagaaccagcagagaagcttgagaagtaaaggaggaggaaaactaggaaagcaggtggcacatgagtatcacataagccaagacgacaggacatggtgtttcaagaaggaaatagtcagctggagggctgctgatgaaagattaagaagcaaaaacaagtgcccaatgttctttctttgtagattgtgtgagaggcataccatttcaaatcatagaaatgtagaaaactttgtttcttataacaatgtatgaagatttccgtgtcttttacactaggaatataagtagatttagcatttttgcatggtctacagcagagtttttccatggttttgttgtcttatttatataggttttgattggcacagcctgtgcacacagcaggacagtattgtacttatatatttttaaaatgtttatatttctctaatacgtattttaatatagatttttatatgtttttatcctatgtgatgacaaattattcatgaatactataggtatgtagtttatagttgcaaatatctttttgtctttctttctttcttttttttttttttttttgagatggagtttcgctctttgttgcctaggctggagtgcagtggcgtgatcttggctcactgcaacctccgcctcccaggttcaagcaattctcctgtttcagctccgagtagctggaattacaggcgcctgccaccacgcccggctaatttttgtaattttagtagagacggggtttcaccatgttggccaggttggtctcaaactcctgatctcaggtgatctgcccgcctcggcctcccaaagtgttgggatcacaggcgtgagccaccacacccagctgcaaatatcattatttttaacaaaaaaaaacaagtttatgaaacaggaatttgatggaattatcctagaataattttcctatatgtgtatatattttcttaatactagataccctgaaatagttttttgcttaaaattgatctctattaaagaaataccaaaaccaaaaacatcccgcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccgtatgtatggctttatttttctcacaaaatgtggatttcatggatttatcagaaaatacatttacatttgttgaaactctataagcttgtgataaattggaaattataaaaccaaataatatcataataattctgaagggtcaaactttttggttttcatgtcagctcattgcatagcctgattattggtaatattttttttaaaaacattttagtatatgatacttattttataagcttggagaaaatttggtgtttttggaatatttgacagttttagagcagaggtatttgttatagcataccaaacattggatatctttgtcttcagggaatgtaaaaattattaactagttatattccagatagtttgaaggaaaaaatggtacttgtttagttaaggcaaaaagtgctgggaccaagactactgaaaataatgcagagggatgacccatttttttgaagtttgtaaaatactcttatttgagatctatatcagtcagagttttcctgagaaacaaaaccagtaggacagacatgcacacagacacagacacacacacacacacacacacacacacactcacacacacagcagggtggagggagagagagagatttgaaggaacagactcacatgattgtgagggctggcaagtccaaaatccatgaaataggctggcaggaaggaaactcaggaaagagttgaagttgcagttttgtggagcagagcagttcagtaagctaaaaactcaagcaggattcctaagttacagtcttgaggcagaattcctttttctccaggaaacctcagtttttgctcttaaggccttcagttgtttagatgaggcccattcacattcttgagggtgatctcctttacgtacagtcagctgattgtaagtattcatcatatctccaaaataccttcacagtgacatctagatgagcgtttgaccaaacaactgggcactatagtcttggcaagctgatacacaaaattagtcctcacagggcctgtttgcttcactccatgtatatcatagctagtaggaagaatttagctaaaattaactgattaaatgtagtaaatatgagatgaataaagcgaaattcaggcatcaaattactattctcttgggattctacaaatgggagttttctggattcttattcccatcatctttggggaataagaacctacttgttttaggtaacagtcaatgtgataaagaagttttcaaaaattaggtagctaagtagagtatattcaagtgtcatttttatgtttctttcatttcctcagcttctctgtttgttaatatgttggatactataatttcatccctattgttttataaattattttctctgttgtttatattttttagatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtattacttttcatttgatttttcaaagtaccagtttgcctaacaaatgtggttaagagggacagggaaactgcatgttctagttaattaaagtttttgataaactaaagttacgtgagttttcagagaaacagaggctttatttaaacatctttgggctctctcatcagcatcaacctctagctatctctctaaattaaaattggttacagttagttcagaaagattttcctcacacttaatcataaagaaccaaatgattttacattttattgtttgctataatgtgaaggctttcctacttaagcctctcaatgatttgtgtaaattctccagggccttatttctcattagaatttttccatttagcaactgttttttaagaggttgtctttgcatgtatatttagatagaatgtttggggatgcccttgtaagttttcatgatatttgattaacagatcaaggtaatttgtttgcaggaaaaacatattttgtgaaatttctctatacactgacctctctttctgtattggatattaactggtgcttcttcagttgacacttcatagttttgaggccagcaattcttggaaaataatgattgattttttatatctcatagatagtccttttttattaaaaacaaacaaaaattctgatttgaattgtcaaattatctactttttaccttgaaatactgtgtgtggtgtactactaaagttatttgtggaactggaatttttaaggtagcttgcttctctgtgtcccttcaaattgtgctgttattttagaagcaggtaaaataatgagattttgtaatcttatcctgcaaatagcattcaacagcctgagtcaatataccttccaagctaacatatacttagagagtttggctttgaatatagtgatgcacaattatattttttttttgtatattatagagaaaaacataatttaagggaatttggtgcaatatactgaattatataactttgttgagtttttttcttttattttaggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtttgtggcatttcttcagtttcctgatcattccaataaaaccctttcaggagtgcccatgcttacctcataatcagtttgaaatcttattcaggtatttaaatggaaccacaaaaaaatgccctcgaaaatgtttagtaactactggataatacatttgcagattataataagtatattactatttggatggagataatagatttttgtgtagaaagtaacagacacttatttaatacttacaaagttctaggaaatgtttccagtggtgtgcatatacacctgcacacccatggacatgtgtatgcacacgcacacacactgatacttgtcaaaggggagaaatttataggcttctttgtgcttctagcaaagagtagtgcaatgaaatagattacatgaagaggatttgtgaatacagagactggtaactgcttctctttttgaaaagttgaaatgtaggaaattggctatgatattctctaatggtaatgaggagaaatcatagcaggctgctctgccaagatctggggtgggtgatcagaatgcatggatgtcctgtggctcaagcagacagcccagcagtctttctcagtctgaaccacagaaagtgattgagtgactttttttttaattcctcccaaggatggtacatgtcatatcatcctctgtgcatgcattatggcattcattgccactggatgcattatggcattgggattaattatctcatgggcaagaaaggctgtccaagaagtagacagattggtgtcatcttgagaaaaacttgcagggtgaattatgtagctagagagaatgaaaaaggagaatatattctctctgtcgaggaatggtgaagaggggaattctgaagcctttgggaacacccaaatcaactccatgaaggcttgagcatttgggtgctgctttcatggaggtgtgttattcagccagtgtcagcttagtttcatataaacttgtgatccatagaaaataggctatcatttccggataagcaacaagcctattacactaatccatacttacagtgctaccttttgatgtgttgtgtactcgagccttttgtagttgcttaataaagaaaacaaatggggtcttcttagtgagacatgggtttcatagctattcctacattcctgtacaatatgtcctcagttaatgtccacaggttcttggaaactgcagctttaagtgaaatgatgtacaatgtaaccaattttaccgtaagctaattgatataaaaaacaatagttaagttcctacagcatatttctggtcacaaaaacagcgccagacttataataaagatcagctactttgaaattaaacattgaaataaatgtgagctatacctgcatttgagaaagagtaataaaaacaaaataattattcaccctatttttccatttcaaggttgtaggttgccagagccttccatggtagctcagggctcaaggcagggatcaaccctggacaggactccatcccatcgcagggcacagtcacactcacacccacactcactcagactggaatcattgacacatgctgattcagcctcacgtgcacatctttggaatgtgggggagactggaacacttggagagacccatgcagatatggggagaatgtgcagactccacacggacagttgccctggctggcaattgatttttttctcatcaacattatatgaaacagcattgagtgaaactgtgtgatttgaagacctgttgtagttccttgggaaactgactcaatgtcatgaccttactttatcaatttctaacctgcatttcctgtatccgacagctctcaaggctaaacagtacaaaaatggaaaaagagaagtggattaagttaaccagagtatcattgtatcaagtctcacttacaaattagaaaaagtttaaaaaatacaatatgcctaaattgtgtaactcgaaacattttcccatgtattcatagcattacattctgaacatattcaatttataagctgctaaagaacactagggggcaatcctttaacttttccagaaatagctggtatcattttatagtaagttttcatttgacaataaggcaggccaaagagaagattagatattgtattgttttactaagcaacgtgtatagtacaaaattgctctcaggcataagaaacccaaaatatgtgatgtatattacatggactaacacccttgatctgcctagttgttagattgtttttcacggtacctggaacattttgaagcatgtggtagtgcacttttcatttcatttgaaagcttagcattgcatttcataaaaatacttagctttcctaatatgataaatgaattatcatttatgaatttcttaatattgtctttgaacccattttaattatttttatgatttctattttcataaagagtgacaaaagtttactagtttatgcatgcataaaaaccctcttttttggtcactttaatatctctttttaacctatttcaagttgcacagcttccttctctctggcacattccaggattgtggtgtaagactgcacatagatttttaggtgttggtgagttagtcttccaaggaactgtttggggaaaggtgtgacatgcacttaaaccaaagacaagatttttttcaacggtttctttcttccctctcacccggtatataacccattgctctttgaagattgggatattagttacaagagtttacatcctgtcctccctcttctaccttcttggataaaagttgagactttggacaggtaagccacagagaaggaccgcaagggccatgatgtatctaaccctctgtgctgtggcttctaacctgcaagtgggtcttttaacagggtaggtttccattaggctctaagaacaaaagagtcttgatgtaggtttaacaccagaaccttcgagtgtcaactgttagcacctggtaagttgttaacacctggttaacagctggcttttttttatgaggcacagactgacaataagaatcattgacctgctaaagaaacaagcctaggcttgaaatactttttcagaatgcaagaggaattttatatttgtggctgggtcatttattgagcacttattatgtgccaatcactgtgagaagctcagcagatacgaagatgactgagaaataattcctggtgccatgttgctccctgtctagtgtatgaacagccagttataagagcatgtggataaatagtgttggcatgtgcacagggtgttaaggtaccataaatcgtttctgtttgtgcccaatgccatcaagaacaataggcaggaattgctggcaagatggccgaataggacagctctggtctgcagctcccagtgagatcgacgcagaaggcaggtgatttctgcatttccaacttaggtacccggttcatctcactgggactggttggacagtgggtgcagtccatggagggcaagccgaagcagggtagggtgacgcctcacctgggaagcacaaggggttggggaatttttgcccctacccaagggaagccatgagggactgagcctgaagaaccatgcattctggcccagatactgtgctttccccatagtcatcacaacctacacagacaggagactccctctggtgcctacaccaccagggccctgggtttcaagcacaaaactgggcagctgtttgggcagacaccgatctagctgcagaagtttttttttttttttttttttttcccttacctcagtggtgcctggaatgccagcgagacagaaccgttcactcccctggagagggggctgaagccgggaagccaagtggtcttgctcagcaggtcccacccccaaggagcccagcaaactaagatctactggtttgaaattctcgctgccagcacagcagcagtctgagattgacctgggacgctccagcttggttgggggaggagcgtccaccatggctgaggcttgagtaggtggttttaccctcacagtgtaaacaaagccaacagaaagttcgaactgggctgagcccaccacagcgcagcaaggctgctggggtcagactgccagatttctcctctctgggcagggcatctctgaaaaaaaggcagcagccccagtcagggacttatagagaaaacccccatctccctggcacagagcacctgggggaaggggcggctgaaggagcagcttcagcagacttaaacttccctgcctgacggctctgaagagagcagtggatctcccagcacagcgttcaagctctactaagggtcagactgcctcctcaagtggatccctgacccccgtgtatcctgactgggagacacctcccagtacaggctgacagacaactcatacaggagagctctggctggcatctggcaggtgccccgctgggtcgaagcttccagaggaaagaacaggcagcaatctttgctgttctgcagcctctgctggtgatatccaggcaaacagggtctggagtggacctccagcaaactccagcagacctgcagcagagggacctgactgttagaaggaaaactaacagaaaggagcagcacatccactcagagacctcatccaaaggtcaccaacatcaaagaccaaaggtaggtaaatccacaaagagggggagaaaccagagcaaaaatgctgaaaattccaaaaaccagaacgctgcttctcctccaatggatcacaacttcttgctagcaagggaacaaaactggacagagaatgagtttgatgattgacagaagtaagcttcagaaggtggataataataaactcctccgagctaagggagcatattctaacccaatgcaaggaagctaggaaccttgaaaaaaggttagatgaattgctaactagaataaccagtttagagaagaacataaatgacctgatggagctgaaaaacacagcacaagaacttcgtgaagcatacacaaatatcaatagctgaatcagtcaagcagaagaaatgatatgatagattgaagatcagcttaatgaagtaaagcaagaagacgagattagagaaaaaaaaaataaaaaggaatgaacaaagcctccaagaaatatgggactatgtgaaaagactacgtttgattggtgtacctgaaagtgacagggagaatggaaccaagttggaaaacattcttcaggatattatccaggagagcttccccaacctagcaagactggccaacattcaaatccaggaaatacagagtacaccaaaaagataccccttgagaagagcaaccataagacacataattgtcagattcaccaaggttgagataaggaaaaaatgttaagggcagccagagagaaaggttgggttacccacaaagggaagcccatcagacaaacagccgatctctcagcacaaaccctacaagccagaagagagtgggggccaatattcaacattcttaaagaaaagaattttcaacccagaatttcatatccagccaaactaagcttcataagtgaaggagaaataaaatcctttacagacgagcaaatgctgagagattttgtcaccaccaggcctgccttataagagctcctgaaggaagcactaaacatggaaagtaaaaccggtaccagccactgcaaaaacataccaaattataaagaccatcgacactatgaagaagctgcaccaactaatgggcaaaataaccagctggcatcatgatgacatgatcaaattcacacataacaatattaacattaaatgtaaatgggctaaatgtcccaattaaaagacacagactgccaaattggataaagagtcaagacccatcttcaggagacccatctcatgtgcagagacacacataggctcaatataaagggatggaggaatatttaccaagcaaatgaaaagcaaaaaaaaaaaaaaaaaaaaaaaagcaggagttgcaatcctaatctctgatgaaacagactttaaaccaacaaagatcaaaagagacaaagaaggccagtacataatggtaaagggatcaatgcatcaagaagagctaactatcttaaatatatatgcactcaatacaggagcacccagattcaaaaagcaagttcttagagacctacaaagagacttagactcccacacaataataatgagagactttaacaccccactgtcaatattagacagatcaatgagacagaaaattaacaagggtattcaggacttgaactcagctctggaccaagtggacctaagagacatctacaggtatctccaccccaaatcaacggaatatatcttcttctcagcacctcgtcgcacttattctaaaattgaccacataattggaagtaaaacacacctcagcaaatgtgaaagaatggaaataataacagtctttcagagcacagtgcaatcaaattagaactcaggattgggaaactcactcaaaactgggtaaataacaaaatgaaggcagaaataaagatattctttgaaaccaatgagaacaaagacacaatgtaccagaatctctgggacacagctaacacagtgtttagagggaaatttatagcattaaatgcccacaagagaaagcaggaaagatctaaaatcgacaccctaacatcaaaattaaaagaactagagtagcaagagcaaattcaaaagctagcagaagacaagaaatagctaagatcagagcagaactgaaggagatagagatatgaaaaatgcttcaaaaaatcaatcaatccagtagctgattttttgaaaagatcaataaaatagattgactgctagccagactaatgaagaagaaaagagagaagaatcaaatagacacaataaaaaatgatataggggatatcaccactgatcccacagaaatacaaactaccatcagagaatactataaacacctctatgcaaataaactagaaaatctagaagaaatggataaattcatggacacatacaccctcccaagactacaccaggaagaagtcgaatccctgaatagaccaaataacaagttctggaattgaggtagtaattaatagcctaccaaccaaaaaaagtccaggccaagacggatacaccgccgaattctaccagaggtacaaagaggagctggtaccctaccttctgaaatgattccaaacaaaagaaaaagagggaatcctccttgactcatttcatgaggccagcataattctgataccaaaacctgacagagacacaacaaaaaaagaaaatttcaggccaatatctgtgatgaacatcgatgagaaaattgtcaataaaatactggcaaaccaaatccagcagcacatcaaaaagcttatctaccatgatcaactcggcttcatacctgggatgcaaggctggttcaacatatgcaaatcattaaaagtaatccatcacagaaacagaagcaatgacaaaaaccacatgattatctcaatagatgcagaaaaggcctttgacaaaattcagcagcccttcatgctaaaaactctcaataaactaggtattgatggaatgtatctcaaaataataagagctatttatgacaaacccacaaccaatatcatactgaatgggcaataactagaagcattccctttgaaaactggcacaagacaaggatgccctctgtcgccacccctatttaacatagtattggaagttctggccagggcaatcagacaaaagaaaggagtaaaggatattcaaatagaaaaggaggaagtcaaattatctctgtttgcagatgacatgattgtatatttagaaaaccccatcatctcagccccagatatccttaagctgataagcaacttcagcaaagtctcaggatacaaaatcaatgtacaaaaatcacaagtattcttatacaccaataacaaacaaacagagagccagatcacgagtgaactcccattcccaattgctactaagagaataaaatacctaggaatcaaatttacaagggatgtgaaggaccttttcaaggacaaccacaaaccactgctcaagggaataagagaggacacaaacaaatgggaaaacatttccatgctcatggataggaagaattaatatcgttaaaatggccatactgcccaaagtaatttatagattcagtgctatccccatcaagctaccattgactttcttcatagaattggaaaaaactaccttaaacttcatatggaaccaaaaaagagcccgcattgccaagacaatcctaagcagaaagaacaaagctggaggcatcacactacctgacttcaaactacactacaagcctacagtaatcaaaacagcatggtagtggtaccaaaacagatatatagaccaatggaacagaacagaggcctcagaaatacaccacacatctacaaccatctgatctttgacaaacctgacaaaaacaagcaatggggaaaggattccctatttaatcaatgctgttgggaaaactggctagccatatgcagaaaactgaaactggaccccttccttataccttatacaaaaattaactcaagatggattaaagacttaaaagtaagacccaaaaccataaaaatcctagaagaaaacctaggaaataccatttaggacataggtatgggcaaagacttcatgtctgaaacaccaaaagcaatggcaacggaagccaaaattgaccaatgggatctaattaaactaaagagcttctgcacagcaaaagaaactatcatcagagtgaacaggcaacctacagaatgggagaaaatttttgcaatctatccatctgacaaagggctaatatccagaatctacaaagaacttaaacaaatttacaagaaaaaaaacaagcccatcaagaaatgggcaaaggatatgaacagacacttctcagaagaacacatttatgcagccaacaaacatgaaaaaatgctcatcatcactggtcattagagaaatgcaaatcagaaccacaatgagatactatctcacaccagttagaatggcgatcattaaaaagtcagaaaacaacagatgctggagaggatgtggagaaataggaatgcttttacactgttggtgggagtgtacattagttcaaccattgtggaagacagtgtgacgattcctcaaggatctaggactagaaataccatttgacccagcaatcccattattgggcatataccgaaaggattataaatcattctactgtaaatacacatgcacacatatgtttattgtggaactattcacaatagcaaaggcttggcaccaacccaaatgtccatcagtgatagactagataaagaaaatgtgacacatacaccatggaatgctatacagccataaaaatggatgagttcatgtcctttgcagggtcatggatgaagctggaaactgtcattctcagcaaactaacacaagaacagaaaaccaggcaccacgtgttctcactcataagtggtagttgaacaatgagaactcatggacacagggaggggaacatcacacacttggggcctgtcggggtgggcactaggggaggggtagcattaggagaaatacctaatataggtgacgggttgatgggtgcagcaaaccaccatggcatatgtatacctatgtaacaaaactgcatattctgcacatgcaccctagaacttaaaatataataataataaaaataaagaacgaatgataggcagtatagaaaatggtattggtgatgcagtcttggattacggaaatggaagagcgtattgagaacatgatcaactcctaaaaactttcaaattcatttttaaattaatctaacctcttttcttctgtaggtgaaccagcttttcctcaaatctgctctaactcatgttccattttagcatttaattaccgctccctggggatctgccacatcatacaaatctgtgtgtaccggatgggcctgtgagcagaggagctaggcgggaaggcacaagtgacctggtgctttaagctgacacctggctattcactcttaggaaaataaagataaagaaaaatcattagctgcccagccagtgactttcatggggggaggggtacactcttacaggagaggtgcgatatacatgattaaaatttttctgtgatttatttgttttttttttttagcacttgacccatgattcatgttcagtgaatgtcattttgaatgaataaaacacctgttaccctcatgttgcccaatatttgaaaccatcatggtatatattttgcaaatttgaggatgtgttgtctaaattcattatatttaaaagaagaagagactttacagaaatggttgatttttacattcaatcaagatatgcaaagtttttgggaatattccaggttgtgagataacttgggggttattaccaagaccaacgtttctatgggaaaatgtgctgtaagtttcaaaaataactttttgcataacatcaatacataaattccagattccccctattttgttggattctaaaattttgaaaatatgtaacacataggattaatttttatttatccaacataaatcagtacactgaaattattcattttgagtaaatatgatgaattattagtattcaatgaggaggaggaaattattcaatgaggaggaggaaagtgagttttgccaagtttataggagctgacactttgccagagtgccccttccgttttcttgatacttgatcctatcatgaacactgcctgtgtggctactgtcattggtgaagccatttgggcacatgtgaaaaatttgaaaatttgtgttttttttgtttagttttgtttgttcttttttgggggagaaggggagacggagtcttgcactgttgccaggctggagtgcagtggcacaatctcagctcactgcaacctctgcctcctgggttcaaatgattctcctgcctcagcctcccaagtagctgggaccacaggtttgcaccaccaagcccagctaatttttatttttattttttattttttattagtagagacagggtttcaccatgttggccacgctggtcttgaactcttggcctcaagtgatccacccgcctgggcctcccaaagtgctgggattacaggtgtgggccactgtgcccagccaatttgtagttttttatactctacatcttccactccttatctcacaccctacatactggtggtttgttttgtgatggggaaaagtgcatgtattgatgaaactgtttgctactaaagcaacctcaggcattatgctaatggctcaagtcaaagaacagcatttttctctgaaaattatttctaaatcactgacactgtttgtttataggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtaattggccctgtgtgtggttctctcagcagaacactagagggcagcttttacaggaaggacggagactcttagagctagaatttctcatgagtaactattttcttaaatataaataactctgtgaatatcaaagtagatgtaacagatatattatataaaataattagtctattttcaacattcagtaggaaaaaaagagatatgtccatatctcttcttgatattttgtatctaatattgaggtattttatgttaaataattaaaattataatgaagcactaatattccacactttttcgcatactaacattgtgaatgtttatgtttaatattcagactttggtttacaggggcgagtttgtcttgatgtagataaatgctgatggtcagatcctgtgatatggttgcaactaagtatttgcatcttctgtctgaggtcgttgtaggaaagattatttcccaatcatttcataaatgcacatgagaacaaagaacaacttgagggctttcctttcctttcaggcggattctgtcaatatatgaaaaagacaaggctgttatctgtggctatggtaacgtgtgtatgtttgaagccattgtgtgatataattctatcctactccttcaggtgggagctgaagtgactcgggcaagcctggctcaagatgctgaggtggaatctgtacagatgaatgggcaggaatatgggcagatatagtctctggccactaagggatgctcttcagctactcccgcctgagcatcttctccaaggagaatgaatgtgctttttctcttaaaatagaatacactggctattaaaataactgagagtaaaaggttttttttttctttacctcctcttctttaagagtgaatgaggaaatagaattgattaatgctttgaattttgttgtcttctttttgttcatgtgttgttataaaaaaaaaagattcagcaaaaccattcatttggaggaaaacatttcctactccttatccatgcacattgtcacaatactgtatcaccccaaagggcaaggttagagtccatcatggtacattcacatctttggtgtaacctctatacttgtatcagtgtttggtgtgtgtgtgcacgcatgtgtgtgtgtatgtgtgatgtggctagggcatttcaaaatagccctctagtcatgtagcaagaatgatctcactcaaagcttttggcagttgctaagcagaagcctcactgggctgggcatggtggctcatgcttttaatcccagcaatttgggaggcccaggtgggtgaatcccctgaggtcaggagtttgagactagcctggccaacgtgataaaaccttgtgtctactaaaaatagaaaattagctgcatgtggtggcatatgcctgcagtcccagctattggggaaggtgaggcatgagaatcacttgaacctgggaggcagaggttggagtgaaccgagatcgtaccattgcactccagcctggatgacagagcgacgctctgtctcaagaaaaaaaaaagaagaaaaagagaagcctcactgtaacagagaatctaggctggggtcaaattaaagtagttgttgtttcttttcctctgtggctccagaagttatcctgcggaaccctctcatgtttttctgttattcttcattccaatttaagaaggggagaatgagttttaatatataactcttgattaaatggtatcccaaatttatagctattgagaccaaaagaggtaaactgaattgttcaaatcaaaatgtgaagccaggaatctgcttttattcttactcattgctcagaacttatttcatctataaatcacataccctgggaacgttgcacataaaacaaaatcttacttgatgcttgtgataaagatgggtattaaaaaaaaactttgaagttttctggtcttcaaaaaaagatataaaattaagtcagagctgaaaagaaccctaatagaaggtctagttcatggtgcttactttataaatgaaaaaatacactattatatcttagaagtcaaattttagttctacaaatgaggttctggaaagacccatgaacaagtcatattaaatgccatttaacatattttgctttcatttaaccataattatgcttatctttttttggatgttgttcattcaaaagataacgttttgattaaaaaaagaaaaagctatcaactataacctaaataataaagtaaaataaattttaaagtctgagatgttatttcttaagcacttctctttaattcagtatgagacaaggatatatattgtataaaccaagggaaagtttacgtttaacccattcctcagaaaacaggaaggtttagagagaaataaaatactctaagcatgattttccctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactgggtgagttgtagtttttctaagatgagtcctgtagaatattggaaggatatcactggccactaattgtcttgggttatccttattctggacactaaatgtagttttcgaatacaatgctcccatatttaagtgatcagagtagtgcaggctgcttggtgagaaaaggagagaagcttttttcagtcaaattaacaactccatgccttacctcaaaagactggggtcactaagcaaactactctgtccatacaataggagtttgttgaaagtagttctaagaatctaatttggcaaatacagtaataagaaaaataaaaatacatacagctcttgtatgcatttccatgttcacctgactatttctggcagtagggcagctgttactttagatactttattttttaaagtataccattaggtctttgagagctagtgagatgcaaatgttagatggtttgacctctaccgtgttatagcaagctcattgcaaatttagataatgagagtttataaagaaccctccagtgggctctgaatctgaggatctccctccttgattcacagggtcttgttggtcaccagccaaacgccatttacactcagtaagaaacctaatgaatcctgcagaggactgagatcctcagtctctcagaaaggagggaatgattttcattttcccaagatctcggcatcactgagagataagaaggaatgaaagctaaggtcctatagaagatgggggatgagggctaggccagtgaaaatgacaacattttcatgccagcttccatcctaacaggaatcccagaaaacagaaagagagaaattagctgcgtgattgagagacaccatagtgtgataactgccttggatactggggtttctttagccactgcataggtgcccctgatgtgatgtctcagacattgtctcctcttgttttccttttggcatgtcccctaagttaaagatatttaattattttttcctgtttattttctagccctttttttcctgcagaaactcttgtcttttacttccttacccctctgtcactttgggtgatatgcatagcttcatataatctagggtgtttgcaaaaattttttatgttagtaaccacttgctacatatgaaaagacttatgtgtagaaatattgcttattatgagtgtatatgcggctttgtgcttacatatcacattagtcttcaaacgcttttgtgagtttatgttaacttgattcagctaaaataacaggagttcccaaataatagatctgtatcttcaaacaggttcatttagttttttgagcctttgtaataaattttcaaacacaatggaaagtacagtgaacacccataaactcactgactagatttatttatttattttatttttaatttttttttttgagacagagtcttgctctgtcacccatgctggaatgcagtggcgccatctcaactcactgcaacctccacctcccgggctcaaggtattctcctgcctcagcctcctgagtagctgggattataggctcgcaccaccatgcctggctaatttttgtattttttgtacagatggggtttcaccatgttggccaggctggtctcaaactcctgacctcagaatccgccctcgtcggcctcccaaagtgttgggattacaggcgtgagccactgtgcctggccttgactagatttaatagttgttacagtctgctatatttgtgacattttttctgaagcattttaaagtaaaatacatagattatgatatttcaccccaatctacttcaatatgtatcctaaaaatatgctggggccagaatttaaaccaaagcctgacactaagtctatattaaagcttgcctaacaccagtatcttttcactactggattttgtcattgagccaggaaagaaaaagatataaaggagaaaagtaaacagggaccgaaagcaagatttgtgtggtctcctgtaagtttacctctcccccgacccctttttaaaaatgttttaccttttgtgaactataattgaattttggaaaagaaaatacactactacagttttaaaagtcaaatcccaatttaagaaaagaaataataccctactttgctttttcatgttttctttcagggagcctttcattttcccacggtgaacaaaggaaaggagttttcctgtggacgtttcctagccctggttggccagaggcctttgttcttcacctatcaggagtgcagagcagtgctcctggcggagctcaactccggtaagaccaacctcattctcacccaagaaattctctgaggaataatctggaattcatccatcaaaacagaaaaaggcacaagggttattctccttgaagcaaacacaaacatagttttagtgtagagcatcacgtggcgtgcatgctggagagggaggtggctcttaggagccccaccacccactgtttgctctaaagagagctcctcatgccccaccttgagaatggggtctggggtaccatctccactaagagccatgatggcagttctcctcttgttaaagacagctatcttctgagaagctgaaaatacctgattgccccaagtgattaagagtaagaataagattaagtaagaataagacatcacagtagggtgataatattacttatttggaccagtggccctttgactttaatttaattttattgaattttactatgtatctataatgactgtttctgcaaatacagtatatttgcagataaatacgtaccagccaaaagcaatttactttccttatttctgggatagactcgaccagagcagcagagggcagacctgctattcagacttagggatttagtcctggctctgccacttactcgctgtgtaactttgagaaaattacttgatctttctgttcttcagtttacttgtaaaataaagaaaattttggggtatgaaaactagagtgtattcaagtatgtttgtgtacatgtttatgtgtgggggatctccattggggaaataaaatatgactttagattatacatatgccatttttaaaatgttcatccagagaacatattttagggttacaaattcaaatgctttaacagcaacaatagttattaacagtattatagtgcttggccaggcgtggcggctcacgcctgtaatcccaacactttgggaggccacagcaggcagatcacctgaggttaggaactcaagacaagactggccaacatggcaaaaccccatctctacttagaatacaaaacatcagccaagtgtgatggtgcgtgcctgtagtcccagctacttgggaggctgaggcaggagaatcgcttgagcccaggaggcagaggttgcaatgaactgagatcgcgccacagtgctccagcctgggcaacagagtgagtgagactccgtatcaaaaacaacaagaagtagtattatagggcttaccctaggccaggcataaatgtttttttttttttgagatggagactcgctctttcgcccaggccggactgtagtggtgctagctcggctcactgcaagctccgcctcccgggttcacgccattctcctgcctcagcctcccgagtagctgggagtagttgggacgacaggcacctgccaccgtgccctactaattttttgtatttttagtagagatggggtttcactgtgttagccaggatggtctcgatctcctgacctcgtgatccgcccacctcggcctcccaaagtgctgggattacaggcgtgagccaccgcggccaggcataaatcttacagtgcttactctaggccgggcataaatacacacacacacacacacacacacacacacacacgctctgtctctctttactctccccagcaaccttacaaagtagattatattatttgtctcattttatagatgacgaaagtcatagatagattatgcgataaacccagaagcacacagttaatatatgttggggccatgatttcaacccaggctgaatggcctctgtgtgaggtattaaccactgttttatgtactgagtgctggctgcttgacaagagagagtaatgggacctgaagaatcctccctaaaggcatttaaatttatattaaaaccaaaaacttgttagcaaaagaaaataaacctgtagacagaattaggccgagagaccagcagttgtaacctctgatatagctattaactcacaacaaaaatctataggaaaaaaactaagaataaatgattctatcatgggtgtctgtcctcattcatacataaagttttagccacatttgcatgagaggttagttccattactggcagctgaagaaagcaaggattttactgctagtgccagtaactatttctatttggtagataacaaagctggcagaggtccagaacattgtagtaatattgttccccttgtactgatcctaagagagagcctgattttcacatccctcagacagctgctctgggatgatggagaaatagaccagagacctataagcttttcatttagctcagacttgttagttcctgtccctgcttttgcagctcctgttcttacatttcttttgcccttacatatcaataaatagggtttgatggaatttgaaatggcacgtcattgttaagttgctgccctcatgagcagcattttaaatatgtgaatgatgaatctctacagtcatattcctattttttaaaaaatcaatttcttcatgatttaatttttttcccagatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacaggtatatctttgaaatgatggagataaaaatatacttttatggtacataatttgtattaaggtgaatctagcttaaatttaatggaagaaggtgaagttcttaagttattcataggaatgcattaaagtgttgtttttctgtagcatggacccatgacatgaactcatgatgtgctgttctgagggccctataatttaatgtactataaatgtcactgagatcagagccagtaatacaatctataaatctatactctcacaatataaataacgtttaatttaatcatccaaacacatgattgcctatcctgttttgaaacttgattctaaatttaccagctactttcagtaatccatcctaaagtcaaagatctcattggcaggaaattcttttttttttttttctgttaccaaaaagatttaaactgttgccttttgttttgcttttgacccaatgtagttgatatagccatcatactattgtgtatatacgttacaatagcttaaaattttaataatttttttgtttctcatgtatcttatgcaatcttttcatgacagtttgcagtttacctctgaaatcatactgtatttttttttttttttttggagatggagtcttgctctgttgcccaggctgtagtgcagtggcatgatcacagctcactgcaacctctgcctcccgggttcaagcagttctctgactcagcttcccgagtagctgggattacaggcacctgccaccacgcccggctaattttttttatttttagtagagacagggtttcatcatgttggccagctggtcttgaactcctgacctcgtgatccacctgcctcagcctcccaaagtgctgggattacaggcgtgagccactgcacccggcctgaaatcatactgtatttctttaaatgaaatacatcagcatgtcaataccttataggaattagagaagtgacaggctatctcatgattcttttcttttttcattttcatgttttattgtaaagtgacaacttataattgtacatatttagagggtacaaggaatgatgttatgattataaatgcagtgtagaataatttaatcaagctagttaacatgtacattacctcaagtacttaactttttttatagtgagaatatttcaaatttactatcttagaaacttggaaatgtacagtactctatattaaccatattcaccattctgtgcaatagacctcaaaacatatttttgagatttgatgcttcctagagttcgtattttattttagccactcagttttaattcagtcataattttgcaatcttttaacttcctttcatatgctcagcattatctcatttatgttaacctacaaatttacatcaattagtatgatttattcctgtttctacagtttatgaagtgtgttgtaaattcttattctattctacaagttatttactgattttgattcaaattggcttaatgccatttatatatttctattaaaattaatttggtagctgggcacggtggctcacacctgtaatcccagcactttgggaggccgagtcgggcggatcacgaggtcaggagatcgagaccatcctgactaacacggtgaaaccccatctctactaaaaaaatacaaaaaatttgccaggcatggtggcaggcacctgtcgtcccagctactcgggaggctgaggcaggagaatggcgtgaacctgggagacggagcttgcagtgagcccagatcacgccactacactccagcctgggcgacagagtaagactccgtctcaaaaaaaaaaaaaaaaaaaaaaaaaaaaaaaatttatttggcagtcagcatcctccttctcattctaatagagacacagatattttattacaggtatttgaatataaccagggctgatagtaaaaatacttaacaattagtttggcactggccaggcccattaaaatggcttctggaggttctttgctgttccaagccatactccattaattactggatcatggggaggtcttgttgtcctggttagggaagtggcagaggactctttaggggctcaggatagaagttaggtaccaactggaatggaagtgcttccctgttttatcagacaatatagcctaccagtgcctaccccttcatcagctctgagcttagttttaactcaacaggcaaatggtaactcagctgagctctgtgagattctgtaatgtttaccttccctacataaggcacactcatcacacacctgttgcaaatgaccgataccctaccatagctaccactaatgtcgtatgatgtaattggcctgactacaccaccaggcacattcacgtggtcataataccttaagttcctttacctgcaaatgttgccctcatcttttccctacctgacatttttttcttaataatatttctcacttaaccggataattaattttgctgcatccacctacctttataatcttttcacatttagattttagaacaaactttctgagtaagtcagggaaaaaatagtttatttagttttgattttgatcattggcacattacaagtctggaatcattttactagaaatttgaaatcaaatttattattgtaaatgtgacaagggaagtgttttttcattagaatcatgctagttgctattgccttggaaaaggaaatgagggttctgctgtgatagtcttgtaatctacttgaagagcccaaatcctcacttaaggtgacaagaaaagaattgctgccaaagataaaaagtcaatgtcagattctgataccaggctacgaagtgattgcagtgattaattggtgaggatgagaattggcagtctgaaacaaaacacacatgagaccctaggacaaatgtagcccatcacttgcatgtccctaataaaggggctccacatttactttaagaccagggaaatggtccaggggctgatgactactagttcttccctatcaggacagttcagtggttttctgtttccttaacccaacctactccctaatttcagaagttctgtctccttagaatgccaggaatcaggtttcagggtgatgggtacacatgataatatggtttggctctgtgtccccactcaattttcatctccagttgtaatcccccaaatccccatgtgtcaagggtgggatctggtgggagattattggatcatgggggcagtttcccccatgctgttcttgtgatagtgagtgagttctcgtgagatctgatggtttaaaagtagcacttcctttgctgtctctctcctgccaccatatatgacgtgctttgcttccccttccaccgtgattgtaagtttgctgaggcctccccagacatgcaaaactgtgaatcaattaaacctcttttgtttataaattacctaatctcaggtagcatctttatagcagcataaaaatgaactaatacacatggttttcgaggccaattgctttaggatcattgcttctaggaccaatgcaaaacagggccatggagaatagaaagcagtcagaactatgcagtggtatttctctagtctgagaagctggcttagttgctgcctagggtttgaagtgatgatttctgtatagtatgaaccctagttttgttccagtttaaacatttttttttttagtataatggtacccgtaacctcaagtgttgcttaggaaagtttctgataccgagatgctcaggagttccttaatatttctgttttgttctggggcaaatagcttcatggatagcatagagggtcttttaatcaaacgtcttatgtgaaggtaaatccgttgaacagagttcatttatttgacaagtatttattcaacacttactatatgctcagttctgttctcggagctggggatacagtagcgaataaaagttgatgctctagtagggcttacattctgtgagggatatatagccttaaaacagataaatatctaaaatttcaaggactgtcaaatgtaaagtaggatcttaatagaaaaatgaatatgtgtgtgtcagggggaaagagtgggatttgatgttttatttcttcttttcttctattcccagttagacaccttgatgttatcacagtttagtttatttttaataaagatcttttaacaactgtagctctcctcaccacctgtgaatttctcacttttaaaccatctgagctggcaagattagtggagcatgggaggtcttttaaataattcttgaatatattatagccctccattctttttttcagggagtgaccttcacaatggcatcataggattcagtgaggagtcccagagtggactagaactcagggaaggagctgttatgagaagattgcaccttattgtcacaagacagccaaacaggtatgtgtatatatagtatatggaagacgtaacattctgtgtgtctgtacaaatgtaatttcaattcatacaatggtggagggcagggtaagatagaaggaggtagtgtcgaatttggcacgtcttcagatgctctagttcttaatttgtgattatggtacttcgtttatgatcataacttagggttaccttgagtgttttctacttcatgaagtaccatacaaatatcagactatgtaggtcatcacttcatcatattgcctattatctgctcactctacatacataccattttcctgtgatgaaaacttggagtaccaaaactttgtttgcaacttaaaactgtatagtagcatctttagatgctcatcacatacacgtgcttggtatgcacacatgcacatgtgtatatattacattttccattttgggcctaaataatctgtgagaatgttggtctccctttgccctattttacaatagcaaccattatgagtggaagtgttgtttctttagaaaaatcctttttaaaagagaaatgaggaacatttacttgcctttaggacctccctataattctcattttcacattttttggacataatagaaaaatatatttttttaattttctgtttttttttaaattttattattattataatttaagattttttaaattttattattattatactttaagttttagggtacatgtgcataatgtgcaggtttgttacgtatgtacacatgtgccatgttggtgtgctgcacccattaactcatcatttagcattaggtatatctcctaatgctatccttcccccctccccccaccccacaacagtccccagtgggtgatgttccccttcctgtgtccatgtgttctcattgttcagttcccacctatgaatgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatctatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacaccctttccagcacctgttgtttcctgacttattaatgattgccgttctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattgtctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctgtgtcctgaatggtaatgcctaggttttcttctagggtttttatggttttaggtctaatgtttaagtctttaatccatcttgaattgatttttgtgtaaggtgtaaggaagggatccagtttcagctttctacatatggctagccagttttcccagcaccatttgttaaatagggaatcctttccccattgcttgtttttctcaggtttgtcaaagatcagatagttgtagatatgcggcgttacttctgagggctctgttctgttccattaatctatatctctgttttggtaccagtaccatgctgttttggttactgtagccttgtagtatagtttgaaatcaggtagtgtgatgcctccagctttgttcttttggcttaggattgccttggcgatgcaggctcttttttggttccatacaaactttaaagtagttttttccaattctgtgaagaaagtcattggtagcttgatggggatggcattgaatctgtaaattaccttgggcactatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtgtaagaatgcttgtgatttttgtacattgattttgtatcctgagactttgctgaagttgcttaccagcttaaggagattttgggctgagacaatggggttttctagatatacaatcatgtcatctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagaatttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaaatcggctgtgaatccatctggtcctggactctttttggttggtaaactattgattattgctacaatttcagctcctgttattggtctattcagagattcaacttctttgtggtttagtcttgggagagtgtatgtgtcaaggaatttatccatttcttctagatattctagtttatttgcgtagaggtgtttgtagtattctctgatggtagtttgtatttctgtgggattggtggtgatatcccctttatcattttttattccgtctatttgattcttctctctttttttctttattagtcttgctagcggtctatctattttgttgatcctttcaaaaaaccagctcctggattcattaattttttgaagagttttttgtgtctctatttccttcagttctgctctgattttagttatttcttgccttctgctcgcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttccagtttgattgcactgtggtctgagagatagtttgttataatctctgttcttttacatttgctgaggagagctttacttccaagtacgtggtcatttttggaataggtgtggtgtggtgctgaaaaaaatgtatattctgttgatttggggtggagagttctgtagatgtctgttaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttttgaatctgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttaggggtgattttgctcattagttgatgcagtttcttcttagtctcgatggtctttacattttggcatgattttgcagcggctggtaccggttgttcctttccatgtttagtgcttgcttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctatgagggtaacccgacctttctctctggctgcccttaacattttttccttcatttcaactttggtgaatctgacagttatgtgtcttggagttgctcttctcgaggagtatctttgtggcgttctctgcatttcctgaatctgaatgttggcctgccttgctagattggggaagttctcctggataatatcctgcagagtgttttccaccttggttccattctccccatcactttcaggtacaccaatcagacgtagatttggtcttttcacatagtcgcatatttcttggaggctttgctcatttctttctattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttgtacattcttctaaatttttttcaaagttttcaacttctttgcctttggtttgaatgtcctcccgtagctcagagtaatttgatcgtctgaagccttcttctctcagctcgtgaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatgatgatgtacagatgggtttttggtgtggatgtcctttctgtttgttagttttccttctaacagacaggaccctcagctgcaggtctgttggaatagcctgccgtgtgaggtgtcagtgtgcccctgctggggggtgcctcccagttaggctgcttcggggtcaggggtcaggcacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcctggctgctttgtttaaataagcaagcctgggcaatggcgggcgcccctcccccagcctcgctgccgccttgcaggttgatctcagactgctgtgctagtaatcagcgagactctgtgggcgtaggaccctccgagccaggtgcgggatataatctcgtggtgtgccgttttttaagccggtccgaaaagcgcaatatttgggtgggagtgacccgattttccaggtgcgtccgtcacccctttctttgactcggaaaggaaactccctgaccccttgcgcttcccaagtgaggcaatgcctcgccctggttcggctcgcgcacggtgcacacacccactgacctgcgcccactgtctggcactccctagtgagatgaacctggtacctcagatggaaatgcagaaatcacccgtcttctgcgttgctcacgctgggagctgtagaccggagctgttcctattcggccatcttggctcctccttcatgtggcgttatttctgagggctctgttctgttccattgatctgtatctctgttttggtaccagtaccatgctgttttggttactgtagccttgtagtatagtttgaggtcaggtagcgtgatgcctccagctttgttcttttggcttaggactgactcggcgatgcgggctcttttttggttccatatgaactttaaagtagttttttccaattctgtgaagaaagtcattggtagcttgatggggttggcattgaatctataaattaccttaagcagtatggccattttcatgatattgattcttcctacccataagcatggaatgttcttccacttgtttgtatcctcttttatttcattgagcagtggtttatagttctccttgaagaggtccttcacatcccttgtaagttggattcctaggtattttattctctttgaagcaattgtgaatgggagttcactcatgatttggctctctgtttgtctgttattggtgtataagggtgcttgtgatttctgtacattgattttgtatcctgagactttgctgaagttgcttatcagcttaaggagattctgggctgagatgatggggttttctaaatatacaatcatgtcatctgcaaacagggacaatttgacttcctcttttcctaattggatgccctttatttccttctcgaaaaatattatttgtttttacattccttatacagagtattaggatacttattcattgttgaatggagtgtattcaaagaaaaccacataagccctgaggcttaatcctcttatctgtagtgaggaaaattggtcattttctgcatcatcagtggtaaagtaagtgctatactttggatgaagaggtaccatttggtatactttggatgaagaggtaccattatttgataataaactctattagacatggggatgacaccctctgttaaggcattggtgggtttcttgctcacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaagaaatgaagagacacactagtgtcaacttctaattatatttctttagaattaatcattttaaaaccactattgaaacttacacattgttgatagggagattctttgtgtttttcttagccataatgtctaaatctctttgccgacaacaggctttagacagacttgattacattatggtattttgtaaataaacttgtcatttttctatttttttgtttcttgccattctaaaataacaaccatgtaggtttaacttcttttatttgtattcttggtacaattctttccttttctagaaataaatgtcttattcacaattctttttgttagccccttcctacttacatacaaagaaaaaaatgtttatcattgcttaataaatgaacacatgcttaataaaagacatgtcgatatgctaactcttctacacattaaaattaataaaatattaagtatatgctgttagaatcacatttatcttgcatggtatctcttttttatattacaataacatttctttcagtatcactataaattcaaattcaaataatttttattacttactaagtgattttctttttggtattcaaatagtcatggcatggccactggtagtcttattaagctggtcttttgtcttttcaatattacttttaaaatatctggaagcatacttgctttatagcaataacaaatattctagagctgtcttgattttttccctgatgtaagacagccaattaactagtgtcaaaggacttgatttctttgatcagaaaggattttagagatctatatgtatgtactacagctatataggaaagttgatgcaggcaaatgtgttgctgttgtggccaccttggtggtggtagtgctggaaaatatattttccttaaagcctggaatccccactctttttcgtagtttagcatatcacatcattgttttttgcttttcttgagtggagttatcatcagctactaaaactttctgtcacactgacaatgaggaactgaaatttcaatactcaagacatttgatcatatagtatgtcctcacttcacgtcctcaataggctcttggaaactgcaactttacgtgaaacaatgtgctgtataatgaaaccaattttaccatagactaattgatgtttatatcagttaaacagttgacttcctactgcacacagtatgtcctttcatttaaagttgctgtttccaagaacctgtcatggttaagtgaagacttactgtattctacttgaatttaaactcttcttcatgcatttcttccaaatatttttatgcttccatcaaccctctcaaccccatatttcttttttttttcttttttgaggtggagtctcactctgttgtccaggctgcagtgcagtgctgtgatctcggctcactgcaacttccacctcctgagttcaagcgattctcatgcctcagcctcctgagtagctgggattataggtgcacaccaccatgcccaactaatttttgtatttttagtagagacggggtttcaccctgttggcctggctagtctggaacttatagcctcaagcgatccgcccaccttggcctcccaatgtgctgggattacaggcatgagtcagcatgcctagcccccatatttcttaactatagctttccgttaatcaaaataccactttctccatgatgcctcccatgaaacctctagttggagtcgttgattctctaaatttataaaacattatctgttcctttcctatggaaattatcagttatatgcagtgttacaacttatgcatagtttatatagactataagactgttagctgttcaaaaattagaatatggttttgcattcttcataaatatgttttgcatacatgattactaaatattatattgtgcattttatctcaaataggatttttggtgaattagaatactgatacgatctcactaggctttaaacatctgtctcgtacagtagatgttaaacttgtaattctaagaagagagaggagaagagccattaggagtgggcttgggcaagctgaataaagagaaataggaaagttaaagtataggtggggttagggtagactacttcctctgagcttgccctccttgcagaagaatatataattaaggggtaagaaaatgttgtatgcaatacatgggatgctaactgtatatatttgttttcctaactagagaaatgctactgagcccattatcaaaagtttcagttaggtaagagaaaaaaattagtcacacctcttctttctctttcacatatgatattcaaatcgtagagttttcttctgcattctgagaagcagctaattttcaagacattttttccctcattatcttttcacctgttaaaaggcaaggaacaagcaaggttaatatatattctagtttcattaagaggaaatttaaaaagagagaagatggaagatgattattttctcatgaaaatgaaaaagtgtttttcaaaaagtactatgaacttttgatatacattttaacattttacatgttattagtagaagggaatttattactcatccagttcaaattattattatgtcagataaactgagacctaatgatatacacaatacatgttctgtgacaatattcttctgtagtgggctttgagaaattatttggaggtcctagtagagccacccaattattgctagatttttgacctaagcaccatcttcttcattttttgtcaaaggaaagacatcagttacactgaacttattcttggagtcactggagtcagtttaagagttagggttctgataatggaagactttagttcaaatattaactcttctaccaattagctgggtgacattggacaggttgcttagccttcctgagcctcccaggtttaacggggttaataacagggctgtgaggcagataaagaaaataatgaatgagaagttcttagcacagctctcggcagagttggcccttcataagagatggtgagtattgagattattcagaatggatggagatggagcccgagggaatgcaatgacttgagtaataactacatcaacacaagtggtagaagagttacagatattgcagacacaacaaatgcatccacagaattacaccactcattaatggcagtgtccctcacctcaatccagtctattggcactcaaagttttttgactctgtcctatctcagattatcatctctacagtttttcaatactttcacttttgaattatgaagaatttaagtaactcgcccaattcaattactgggccaagattagaactcatctcttgaattccagtccatttccccttttcctgattatttatcttatgattctatattagtaaaatgtaaaaggtaacaacttaggaagcatgctcttaaccacaaaatctgtttgaatccagtgtttaaatatttgttgcaaatattttcaaaaatatttaagtaaggtattgtttcattgttactttggtttttctattgctgaatagttctggtccctggaaaaatcatcttatactagttagggcaaaagatcatcctgggatgcttctgacctaaccaggaaaagaacctgctgggaattacacatggaatgggctcttatgaggtctctgtcatttttaggagtctagggaggttcacatatgatctgcaagtcttgatttctcattagacttcagaaatattgtttcaatagagtgtttatttctaagacttgaagactctttatgttactagtctaatgatatgtaggcacccatctttacactgttcaatttcagatgattcttaacttagattataacatattattttgtttgtaggtggctataagtatgttctaatcatcgtcacaatgaaaaaggaatatttttctagaaaataaaagtctgttggaatgtaatataccgaaatccttagttaaaagaaactactttgaattcaagctcgcttggccatactaggtcttgaatatagttactatactttgatagtgctttagtttattgtatttgccaaatgtagtttctcaaaagtggacacagtacaattatttccatatttcaatatcaactgacagttaatcagcaacagtaaagaatgatatgtgccacagaaaaaactaagtatttcttcagaaaacaaaaggagattaagttgatttatgctataactaagatataacttacttataaacacttggataattctgaagggttggttgtatcatttcatgatgtaatagttatcattaaaatggtcacaaaacataatggtcattgctggtaggtaaaaatgatacattatatcaaattagacaatgtcactgcagttgtaaaggcatcagcttagctcctttgagttatgccagatgggtaacaatattgctaagatttgtggatgattttgttaagagtgaatcattagtaaaaacaggtgattgccaatatgttataaaattgaattcaggctttagaaaataaattatttgagactgttgagaaggaaccaaggtgaaacatgagcaaactgtaaccagcagactatatttagactatatactgaattttggaaaattttgaaaaatacataaaacttcagaattgactattataaatatttgattatatttatttaaaacactttaaaaataaaagaaataaaaatagaaccttacaaaattgaagatccatttttttccccctcctcagtaatattctccaactccactccctgccctgtccccacccaaaccctccacccaaggcaactgctgtcagggtgtggtagttaaaaaagaaaactttacataaatatgtatctattaataaaatatagtaagctttatgtagttttaactttacttttatggtatcattctatacatatcattatacagcttgatattttcacttactgtcatattttgagatgcatctgtgttaaaaaacattgaattagtttattccttttaactactttatagtgttttgtggtatgaatacatttaatttatttttttgctgatcgtagtaaacataggttgtttcctgacattgattttctagtaagaagctcgcccagagaaagtaaatgtatttttaaagaaagaccaaaaataaatgtcatgataatctaagaatttaattccgtaattatacagaatatatctctagatttatatatttatttctctaaaaatgtatatgaattatacaatatttaaatatcagaactatctacagatagaaatatattagtaatagttgtttttttttcctttttctcattgtcaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggtaagcatggaatatatatattcatacacgttatggttttcttctttaactacagcaagagtaatgacatagggaataattgatacattattttctgaggataacatcgtaattcactttttattcattacattaagctttatccttgaaacagctcagcttttcactcatcagtaacagatcatgttttaaaacgacagacttcttttttctctcttttgacaagattgattatacagtgcaaactatcttacataaatctgttttataaaatctctagggagttaaaatttcttcagaatgtaactgttgaaggccagaagcagaaagtgaggatcttgttatgttttgtttccaaaacagttgaaaattttctttttcagaacctccaacactagctgatctttacacttcttcaaatccatgtgttcacaaagcctcactgccacttttttcacatccatcctcttaggtgacatcagataaaagacagggaggctatctggggactcagaagatcaatgctgcataacactaagtcaccagaccgtgggcttggccccaacaataccatatacctttcagccttatttttttgcttttgttttagcagtgaaactctaatatagtaaagcaaaaatctgtccctactctgcttgaagtatgattgttaggatcatagctgacccaccttagtcctctctttgttccccttactttatataacttcaggaaacccactatttgaaaactgccattctggacagctcttctatttccaatgtttcaagattccaaaccagatgaatccttgggccttaagatttcacagtttcattaaaagttccctttagtacctgcctggttgtgtcaccattgggtggctcaaacaggacattctgtgcataaaacagaacatatgtgtggccagtatgttgtagcagttacatgagtcaagatgagagaataggcctcaagctgtggatattaagccgttctgaaagtttgccaggcagtaaaacttatctttacgacagagtccacagtgcagcaaacaaaaagaaaactccctattatatgagaccctagaaataaagtctattctaaatagcacaaagtgaagtatgttgatttacagtaggaagacttgagtatttttattggagtatttaagatagaagataaattatagaagtctgtttcattcttcctcttctcccataaaatgtatatcgttataacttactactttggagaatggaagaagggggactggaaatgaaaaaccagatgataaaagagatttgaggcacatcttaagcgagtttatgtgctcagtcagatgagaggggaattgaagttgccaaaagaagaatctgaaggccagcaactctatcatatttatttatatgttttctagattcttcataagtgattctttgcaaaatgcatgctgtcagtagtgtataactcataaagggcacttatttatggaacaatatatttttaggaatttccagttttccctactgaaatggttaattttatatgtcaacttgactggaccacagagtacccatatatctggtcaaacattattctaagtgtttctgtgagggttattttttggaatgagattggcgtgtaaatcagtagactgagtaaagcagattgccttcataatgtgggtgagcctcattcaatcagtcaaagtcctgaatagaccaaaaagcctggccctcctttaagtaagagagaatttttcctgtctgataggctttgacttggaataatggctttttccggtctctggactcaaaatggaacattggctattcctgggtcttaagcctgctggcttttgcacgggaactacaccattggttctcctagttctcaggccataaggcttgaactggaactaaaccattgacctcctttggtcttcagcctgtgaaatcatcctgcagatgatcttgagacttctcagcctccataactgcatgagctaatttcttaccttataataaatctctctctctctctctctatatatatatacacacacacacatacgtatatatacatatatatacacacacacacacacacaaaaacataagtacacgcacacacacaccctattctgaccctgaccaataaacatcctaccctgcgattataggcttagtagagaatgtttgtggcagtgcattaataccagtatttttattttttaatttttgtaggtacatagtagatgtatatattaatgggatacatgagatattttgatacaggcatacaatgcataataatcacatcaggataaatggggtatccaccacctcaagcatttatccttcctttttgttacagataattcaattatacttttttagttatttttaaatgtacaataaattattgttgactatagtcgtgctgttgtgctatcaaatactagattgtattcattctgactattttttgtactcattaaccattctaacttccctcaaccccctctgccccaccgccaccaccttctcaacctttggtaaccatcattctactccctatcttcatgagttcaattgtttcaatttgtagttcccacaaataagtgagaacatttaatgtttgtgtttctctgcgtggcctatttcacttaacataataacctccagttccatccatgttgttgcaaattacaggatctcattctttttaatggcttaatagtactgcattgtgtatatgtagcacattttcaatatccattcacctgttgatggacactttggttggttccaaatcttgactgtggtgaatagtgttgcaacaaacatgagagtgcaggtatctctttgatacactttcttttcttttgggtatatccctaggatttcctttcttttgggtatatacctgggagtggaattactggattatatggtagctttatttttagttttctgaggaatctccaaacttctccatagtggttgtactaatttacattcctaccaacagtgtatgagggttccattttctccaccttctcactagcattcattattgcctttcttttgcataaaagccatttaattgaggtgagattatatttcattgtagttttgatttgcatttctttcatgattagtgatgttgagcaccttttcttatccctatttaccatttgtatgtcttctttagagaaatgtctattcagatcttttgcccattttaaaattggattattacatttttactcatagagttctttgagctccttatatattctagttattaatcccttgtcagatgggtagtttgcagatattttctcccattctgtgggctgtctcttcactttgttgattgtttctttggttgtgcagaaactttttaatttgatatgattccatttgtccatttttactttggttgtggggtattactcaaaaaaatctgccagtccaatgtcctagagagtttcctccaacattttcttgtagtagtttcttagtttgagatcttaaatttaagtctttaatccatttttgttttgatttgactttctgtgtatggtgagagatagggatctagtttcattcctctgcatatggatacccagatttcccggaaccatttattgaagagactgccctttttccaatgtacgttcttgtcacctttgtggaaaatgagttcactgtagaagtacggatttgtttctgggttctattccattctgttccattggtctatatgtctgtttttatgccagtaccatgctgttttggttactgtcactctctagtataatttgaaatcaggtaatgtgattcctccagtttttttctttttgctcaggatagctttggctattctgagtcttttgtagttccatttaagattatttttcctatttctgtgaagaatgtcattggcattttgataaggattgtgttgaatctgtagattgctttgggtagtatgaacatgttaacaatactgattcttccaatccatgaacattaaatatctgcatttttgtgccttcttcaatttcttgcatcaatgtttttcatagatttgttttggttttttgagatagggtcttgatcttttgcccaggctggagtgctgtggtgtgatcatggcttactacagccttgacctcctaggctcaagcaatgctcccacctcagcctctcaagtagccgtgactacaagtgcacaccaccacacctggctaatttttgtagtttttgcagaaatgggattttaccatgatactcaggctggtctcaaactcctgggctcaagcaatccaccaacttcagctatccaaagtgctgggattacaggcatgagccaccatgcctagccagttttacagttttcattgcagagatctttcacttgtttggctaagttaattctcaggtattttattttacttgtggctattgtaaatgggatttttttaattttccatatggttcactgtcggcatatagaaatgctactgatttttgtatgttgattttaaatactgcaactttactaaatttgtttatcaattgtcattttttgttgttgaagtctagttttttccaaatacaagatcatatcatctgcaaacaaggataatttgacttcttcctttccaatttggatggactttatatcattctcttgtctgattgtcattaaaataattgccatttaaaataattgtcattattttaaaatgatgtcatcttattacagattgcataaacatacaagtgaactaacaaacaagcaaagaggaaacgaataaaaatttgacacctaaactttgtaccccactttttaactttttgttgtttctatttatatcttattatatactgtctatgtctagaaaagttgttgtagttattattttttatccgttcagtgtttagtctttctacacaagaaatgagtaggttacacaccaaaattacagtgttatagtattctgtaattttctgtgtccttgctattaaccatgagttttgtacattcagatgatttcttattgcttattaatatctttttcttttaggttgaagaacttccgttagcatttcttgtaggataggactggtgttgataaaatctctcagctttgtttgtctgggaaagtctttctccttcatgtttgaaggatattttcgcttgatatactactctgggataaaagtttcttcagcacttactaaacatgtcatgctacactctcctggcctgtaaggtttccactgaaaagtttgctaccagatgtatgggagctccactctatgttatttgttccactttacttgctgcttttaggattcttttttttttttaaatccttaacctttgggagtttgattattaaatgccttgaggtagccttctttgggttaaatctgcttggtattctgtaaccttcttgtacttgaatactgatatctttctctacgtttgggaagttctcattattaaccctttgaataaactttctccttctatctctctctttacatcccctttaaggccaatacctcttggagttggcctttggatgatatttatagatcttgtatgcatgtttcatttttattcttttttcttttgtttcctctgcctattttctttctttctctttctttcttttttctttctttctctttctttttctttctctttccttctttctttctttctttctttttctttctccttccttccttccttacttcctttctttccttctttctttcttattcttccaatccgtgaacatgaaatatctgcattttgtgtcttcttcaattgttttgcgatgtcatgttttcctggatggtcttgatgcttgcggatatttgtcaatatctggacattgaagacttaggtatttattgtagtcttcacaatctgggcttatttttacccatccttcttgggaagtttttccagatatttgaagaggcttgggtgctgtgatctaaatttttggttattgcagccatatctgcattagggggcatcccaagcccagtaatgctgttgctcttgcagactcctagaagtactgcattggtggtcttggataagatctgggaaaattccctggattatcaggcagagactcttgttttcttcccttactttctcctaaacaaaaggatcctctgtgtctgtgctgaacttcctggagctgccagagggttgattcaaggactcttgtggtcactgccactgggattgtgctagatcagacctgaagctagcacagcactgggggtctcacccaaggcccatggtgaccactgcataacatatatcatagtctaactaataaaaataaaggcaagaaaaatattgaaagaactgagaaagaaaagtaccttatctttagggcaaaagcaatcggaatgacaggagatttctcatggaaaaccatgggtcccaggtggaaatggcacgctatttttcaagtgccaaaagaaaagaccctccagccctaaattctatatccagtgaacatatctttcacaagtgaagaggaaattaagatattcccagatgaaggaaaaactaagaatttgttgcacacagacctaccctgaaagaatggctaaagaaagatctttaaacagaaagggaatgataaaaaggaaagaactttggaacatcaggaaggaagaaagaacacaataaacaaaagtagatttcaccagaaaggatgtacagatgaagaataagcatataaaatgatgttcaacaccattagctattagcaaaatgaaaccacagtgggatatcactagatgcctaccagaatggctaaaataaaatccatgacaataccaaatgctggtgagaattcacagagactggatcacttattcattgctgatgggatgcaaaatggtaagccactctggaaaacagtttagaagtttcttcaagaattaaacatgaactaccttatgactcaggagttgcagtcctggacatttattcctgataaatgaaaacttatgttcacacaaaaacttgcacatgaacatttatagtagcttattaataatagccccaaagtagaaacaattcaggtgtccttcaatgggtgaatagttaaactgtggtatatccatgtatggaacactcctcactaataataagaaacatactattgatacacataacaacctaatctccatataatcatactaagtaaaaaaaaaagctgataccaaaagattatgtactgtatgattccatttctataatattattgaaattacaaaattataggaatggaaaagaaattggtggttgccagagattaaggagggaatgggctggggtgacacgagtgtagctgtagaagttaacatgcagaattcttatggggatgaaaatgttctgtctcttgactgtatcaataacaaaatcctggttgtaatattatattacagtcatgcaaaatgttactaatgaaggagtttgggtaaagggtgtaggaaatctcctttattatttcttataactgcatgtaaatctgcaattatgtcagaataaaagtttaaacaattggaaatgacagtttcacctctctggtattattttattttcctgttgcttaattgcccttgtgttgttctctaagtgctaggcatattactagaagacagagacatacaattctcttttccagtagctggcatgaatgagaaaataattatggatcaagttgttattctgttatgatattgattttcattttactttaaatagattaatgcaattaaaacagtcattgtaacatagataccctttggtagaccagcattcccatgtacgtaagtactgtagccttagcatctgtggcttatatctaagtttgtgatataaagttaagaaggaatttctggtccttcctatttgagacaataaagacatctattattctagttatctttcagttaaatagacctatagctaaaaacaaatttgaaactgattccaaatactttcttttatatatgtgtgctagctgaaagcacacaagttcaagaaagaccatgtgttttccttattttcacgttgcctattccattcaaagactatttctatattgattttctttttttttttctttttttttttgagatggagtcttgccctgtcgccctggctggagtgcaatggtgcgatcttggctcactgcaacctctgcctcctgggttcaagctattctcccggctcagtctctcgagtaactgcgattacaggcacccaccatcatgaccggctagtttttgtatttttatagaggtgacatttcaccatgttggccaggctggtcttgagctcctgacctcaagtgatccacctgccttggcctccccattgtcacttttaaattgcataattcttctttgtgtttattatatgtattttataaacacaagaacattttgattgtttcatttcctttaaatatttgaactatgaaataaatcctgcgaaaaaacagtgggccaaatgtatacatacagtttttagtaatcaaatcactaccaccttgtttcagaaatttaactttatctgaattttagtataaaactttccattatgaacccctctgatgccatcttgctttttccttgactatccccaccttgcagataatttatatcttgaattttatgttaaattattcatattctttttaagtagttctattcttatatattatttgggtttacctgttttggaaattgtgcaaatgaaattaatccaattgtattgttctatggtccctgttttgttcaatcatatgtctgtgaactatccatgctgatgtgtgtacttgaaatcctttcattttaactgttatatagtatttcagggaatattttaatgtatccattctaaagccattagatttttgagttatttccttcagtaaggctttttattttatcgttacactgcagatgctcttaaaaagcattcattgattttttttttcattttttgacacaatcaatcacttcctccttcctgaagaatgctcttctttgggcttttgtaataacacaccttcctgctcttaatccttacctcacttggagctccttcctgttggctatgttggtcttcctagccagtaaatgttgggatccaccaagaatcaatctccaggctagactatatagaactgtttattaaatatcatctgtacactgaggacttccacatttttatcactaacctcatcacctctcctgatccagacccatgtatctgattgctcttacgtgatgtcgtcacttgaatgtctaagaggcatctcagacttactatgtataacagataactcttgatttgtcccttaacaatattttccccagttttccaccattcattatccatttacccattcatctaggcaagcagctaggagttaccttcacttctcctcttccttccacccaatatcaaattcatcagaaagttctattgactctaagctgagcgtagtggtgcaagcctgtagtcccagatacttaggagaatctcttaagcccaggagttggataccagccttgttgatatagcgagaccctcatctcgaaaaaaaacccaaaatgaaacaaacaaaaaagtcctattgactctacatttaaatatatttctagtctgagtgcttctactcatgtgtatttctagtctgagtatttctattcatgtgaccctatttattctaccactgtttcttgcatgaacgaatgcaaaaacctccatgctcattccctactatatcctaatatacacaatagccagaacactcatgaataatgataaataaaatgtgtcattctcttgcttgaatcctctagggtcttcctgccacattttgaataatgaacctacatgcctacatgatctgactcctatctacctctctgttttttgtttttgttttttgttttgttttttgttttgagatggagtctcactctattgcccaggctggagtgcagtggcataatctcagctcactgcaacgtctgcctcccggattcaagcgattctcctgccgcagcgtccccagtagttggaattacaggtgcttgccaccatgcccggctaattttttgtatttttagtagagatggggtttcaccgtgttagccaggatggtcttgatctcctgaccttgtgatccacccacctcagcctcccaaagtgctgggtttacaggtgtgagtcaccacacccagcctccacctctcttacagcagcatccagcactctccttctagtcacattggccttaggttcttccttgaacagactaagatggttcccatctccagtgcctttgtaattattctttctgcctagaatatttcccaagatccttatgtagcctattcatttatttccttgcagtctctgttcaaatatcacaagagcttctatgtccagttttatataaaatgctaccctttccatcaccgtgcattcccttacctacttttatttttcttcatagaacttgtcttcaggtaaaaatctatcattaattccacaacccttgtacaacctgtatcctctgctagaatagtaggttctatgagtgcaggtattctgctgttcaaatctatatccattgtatgtcacttggcttgtactaggagtttaatagttcttggctcagtagtaaataaatgcacattcctttgattcttccttgactaaagtgttcatgcttcacgttccaaaacactttttccaagaaaacttttcaataaccataatttgaagaagagcagaggtatatatgtccaggaccctactccttaggatatttccatatttgagtgtaaacatgaaaccaatttcttctacttctgctttcctcccctctgccttctctctactctccccagcctgccccccaaaatttctatgtgacagtgaaaatataaatattcctccttttcctgcatacttatattttaccacatgtgttatttgaagcacgattttcaatcacaattggagaaatggaggcaagagtgacatttctggtctaatttgcttccttggtccatttgaaggcatctctttcctaatctcatcactgtatgttatgtatttatctctctaatttatcttagcagattatgaaaagtataaaaccccatctttaggtagtactgtcatcatcattgcccttcagtttgtttaagagaaattgaatttgtttaagaaacaagaatttgtttaggacaagatcagaggtgtcatagattcacttaaatggtgttgtttaatttctaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaaggtaagtttttgtgaatattagtaatttgtttagtgaaattttgtaaatttaaaaacccaagtaaaaccaaaatcacattctcttttaacattggttattatgaaattatgataaatttagatttctgaacataggaatagaatgcatcatatctgacactgtcctcttccttggatatgactgatgcctctttggaaatctcagtcttaggcttggagaatgacctagtgcagtagtaaagacagcctagtgcatgaaaaaaaaggctccagaggttgggagctataggcagttggcgactctccagaaactggccaattaactttgtagtttgagcctcagtttttttagtccattaagaaaaaggacttgagctagattatctacatagtccttccagtttaaatgccatggaatagaaattatcaccctctgcttgttctttagtcctcacgggcactgaaaactttcacagaaaagaaaaattaagaaatgactagataatttcagacattccatttggtatatacttgtacaaaacagattttattttaaacctatttacttacaactctgcaaatgatggaattaaatggagatgtgagagcctaagaatataaattttgaaagatatctataaagttattacttaaaaaaaaagcctcctttggaggtttactttgggctttcttatcaagatatttcctatcaatatatttatatacaagaactgaatgttttgagtacatacccatgaatgtataattactacatctcttacataatgaccttaaaatactttagatgttaacaatggggttttagatagtcgtgcatactttccatccagtggtatctcttaaaatacaatgcttgaaagatagaaaagaaaattataaagtacagaggtaaaaagagcaggccatggcaaacatcttataaagcaaagggaagcgattgctatttcatgcagagaaaattctgcagtaaaaactcactccacaaaatattattacttgaattttctaatggcccaatggcgtaggacaatgccaagttgtttttggccagggaaagagaaagaatgtccagtaattacattttagggaaggaaacaggacctcacttcatatgatttagggaaaatatatggaaattctgctactttttgttctcaataagttatgtatgttaaccaagttattattggttaagaatcaacacttatttcagtagagttgtcagatagtacatcttgactgttactagtactatcgtgaataatacaatggaattataaaagtagctcctatgggaaaatgtaattaactttttttgagtaaccattagcaaacagtacaattttctcatatatgaagatacttaaataaataacctgggaatacttggagggataaaatatattttaaatgttataaaaatattgtaatattgtaaaatattgcctgtaatcccagcggaggcgggattgggaggcggaggcaggcagatcacttgaggtcaggagttcaagaccaccgtggccaacatgtgaaaccctgtctctactaaaaatacaaaaattagccgggcatggtggcacatgcctgtagtcccagctatttgggaggctgaggcaggagaatcgcttgaacccaggaggtggaggttgcagtgagccgagatggtgccactgctctccagcctgggcaacagagcaagactccatctcaaaaaaaaaaattgtaaaatcaagtagaaaacatcatttgaattcttaaaagaaaatgactagtattttatttcagccaaagccttctttgctctggttattttcaaatcaagttattgtcactacttttttaaaaatagtatgatataatgtactctcaaattccttttttatatgtacatcaatactgaaatctgttgatttaactgacttatttaataattatagaaatatatattacatatgtacatacagaaaatatataaagaaaacaaaaattctactaacatagacttcagtaaatggaaattcataccttgttctgcaataagaagattcaatatatggacacaacagttttctgtaaattaacctataaatgaatcgtaattcctatcaatatatcattaggttgttttggggttatttttacattgataaaatgatactaaagtttacctggaaatgtaaacatgtgaaaatgggcagaactttcctgaaaaagaagaaaaaaggagagggaccttgccctagcagatatgaaaacatatttgaaatatggtgttactgtgattaaaggggcaccggtgcagacataaacattcacatcaatggaatagaacaaaaagttcaaaaactgaagcatagatgaaaattttatatgtgataaagtgctatttaaaaatcaatgggtcgaaaatattattcagcaaatagtgttggatggctgatgtaaccatttgaaagcaaaatagagctgaaccttatcctaaattctacccccaataaattctagacagatcaaatatttcagtgaaaaactgaaaccatgaaagtagcagaaaacgtggatcagtcatttcatcgttttagtttagaatggggaagatctttccaaagcctcagacaaaacccagaagccacaaaggaaatgactgataacttgaccacatacagtttaaataaaatttctcttagcatacaccaaagcaaagtgaaaacacaactaatgagtgtggggaacatttttgcaaatacacgtgtgatgagaatgtttatttcagcattacttcttataacgataaaaactgggaaaaacgatagccattatgaggggcctgactaaatgaatgcatgaaatgtatttaaaagtgcaagaaatacatattttatattttaagcatagcaataataatgagaataataaaacaagaactgaaaatttggattatcacataaagataaggtggcaaaatttaccaaataaaaagaaggaatgctcagttaagtttgaatttcagataaaccacaaatacattttttagtataagcatattgcagatacttatttgggacatatttataccaaaaagttattgttgcctgtctaaaattcaaataaggtcatttgtactttacctggcaaaccatttatatatgccatatgaaattatatacactctaaaataacctcatattaaaaaggacagaatagaacttccaagtactggaaggtacttcattctgtaagatattatattttaagtgaaattgttttacatttttaaattttattttcccccacattctaagttctttgaaacaaaatctattatatacaatgtatttcttttaaaagatctcaataaatcttaagtaatattattacacatgctagaagtggcacaagtattatactaaaaaagagcatcagctttaaatgcctcactataaagactttctgtatgaaatccagctgtgggttcaggcaaatttttgctatgacagaatattctatcccctgattttcccaggcatagtgaaataaaaaatattttaaaagctcttagtcgtcttaatagcaagagcagtctaaaacccccctgaatctgatatgctaactttcaatttcgtcaggttttgattttgtcgttatcaaagcttggcaaagcccatcaggaggtgttgactctaattttttgttctgaaacacttgaaagagcacaggaataattagttctgtaaaagtttgatagactatcccctacctccaaaggcctccgtctttgtcttctatcctgacaacttcttaagttttttccatggttgattcaggtcttctacttgttcgtaaggcaattttaataatgttgggagttcttttgttgtttgtgtaaactggccttgtggagccagcctgtttcttttcatcatatactttttaataacagataccttatatttcaagaattagtttttacacttgatttattttgtaatcatactaacaaggattttgagttaactctgtattttactggctggttttgtatttcatgctcgaggtaattttgactgacttgtctgtgaactgagtcagtccaggtggttgctttggcacaagcaagtggggagtgttgccaggcagtgtagggcggctgtcaggagcacctcctaggcttcgtggtcaccaactgtgtgcgaacacaattgtgcgcaaacaaaaagaacaagttagtcatcctccttctgccttagtttccctaactggaaacaaagacaataggaccttcctcacaggttgttgtgaagagtagttgctagaaagtgctgaaaactacaaggtccctgtactaactgagtattatagaaatggcctttttgtttcagttttgtgtgctttactaaaagaaactttgtttttttttaatatgaatgaaagtgtgggtagccatagaatgcctggatcacagcctttaattcttacaattctgaacatattgcttggctggcttctgacatttcatttttagaaaagtcggaagttaaactaaatttttgtttttctgttggtaatttttttcctgtctggtttctggtatgattttttttttactcttgaaataatattttttaaaatcacccaaatatatctggtgttgtctctttttctaattttccctagtataaaagcaatctctacatttttagacatgaatattcttcagcattttaaggagctgtgttattttttgcctctgcctgctcttttatatatagaattatatcttagggatttgtcaagatttgtcctactagcctgttatcttttctctgagttctgggagattttcttgagcttgtttccatttatcatattcagtttgcttgtttcagtatccagtggttgtgctctgtctccatttgtaatttttgcattgctaaatttttattctgtgtcttttacatttccctgtgggttattctccactctgccttactatgtgggagatgactattcttataaatgccaatcttgagctctaccatgagcttggaactgtactagattacaaagtcataaaaaaatgaggaacatgatccactttcacgatgagcttgaaacagataaatcatttcaaggttgtcataagttcactgataaagttacatgtaagttacaaagagagtgataatgtaggttggtagatggggcatagtgtaagaatcatagagcttgaaacagataaatcatttcaaggttgtcataagttcactgataaagttacatgcaagttacaaagagagtgataatgtaggttggtagatggggcatagtgtaagaatcatagagaaagtgatgacttttagagtttgaggaagtaatagggacttatcagaaggtaatggagtaagtggcttcacaccaatgcttaaacgataaagatgtggtcctgtgtccggaattggtgggttcttggtctcactgacttcaagaatgaagccgtggaccctcgcagtgagtgttacagttcttaaaggcggcgtgtctggagtttgttccttctgaggttcggatgtgttcagagtttcttccttctggtgagtttgtggtcttgcgggctcaggagtgaagctgcagaccttcgcagtgagtgttacagctcgtaaaggcagtgtggacccaaagagtgagcagtagcaagatttattgcaaagagcggaagaataaagcttccatagtgtgcaaggggacccgagcaggttgccactgctggctcaggcagcctgcttttattctcttatctggccccacccacatcctgctgattggtccgttttacagagagccgattggtctgttttacagagcgctgattggtccattttgacagggtgctgactggtgcatttataatccctgagctagacacaaaagttctccatgtccccactagattagctagatacagagtgtcaattggtgtatttacaaaccctgagctagacacagagtgctgattggtgcacttacaaaccttgagctagatacagagtgctgattcatgccttcacaatcccttagctagacataaaggttctccaagcccccaccagattaactagatacagagtgccaattggtgcattcacaaaccctgagctagacacagggtgctgattggtgtgtttacaaaccttgagctagatacagagtgctgattggtgtatttacaatcccttagctagacataaagatctccaagtccccaccagattaactagatacagagtgcctattggtgcattcacaaaccctgagctagacacagggtgctgattggtgtgtttataaaccttgagctagatacagagtgccgattggtgtatttacaatcccttagctagacatattctccaagtccccaccagactcaggagcccagctggcttcacccagtggatcccgcaccagggctgcaggtggagctgcctgccagtcctgcgctgtgtgcccacactcctcagcccttgggcggttgatgggactgggtgccctggagcagggggaggtgcttgtcagggaggcttgggctgctcaggagcccacggtggtggggggaggctcaggcatggtgggctgcaggtcccgagccctgccccgcagggaggcagctaaggcccggcaagaagtcgagcacggcagctgctggccaaggtgctaagcccctcactgcccggggctggcagggctggctggccgctgaatgcggggcccactgagcccacgcccacccggaactcgcgctggccctggttcccgccctggttcccgcctctccctccacacctccctgcaagctgagggagccggttcccgcctcggccagcccagaaaggggctcccacagtgcagcggtgggctgaagggctcctcaagcgcggccagagtgggcaccaaggccgaggaggcaccgagagtgagcgagggctgtgagggctgccagcacgctgtcacctctcagtcccccgtcattttggatttttcctccttttttcccctgtctctcaaaaaaacaaataacccagtttttttttagtaggaagggtcatacttactgaaaaaggcaaaagctcttgactaatcttgaaaaggattttctcatttggtgctttaaatatttagtgattatggtagcttctgtttactggaaaaaaataattttgccactattataaacaaatattcttgaggtatttatttccttatttgttggtcaaaagaataagaatccctagggtagatgtaaaagtgagactaattttaactcatgatgttaattattgtagttaaaattaaataatctgtgcaggcatttaggactttatctaatgattaagtagaaaatattttggtgattatgccttttctttatagatgattacttatgccttttcaactgcaaatatatatatttgaaatataattttgataccaatttctcttaagttttcataggtttatccttactaatgttaataactattaataaggaacacacacacatatatgtatagcatataatttaagaaatttatttttatagatatatttttatacttagattctttttccagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaagtaagtatcttttaatatattagcagtaccttttatgcatttttttcactgtttacaaagcaatatgtaatgcaaaatgacatttagatgatgtaactaagaatgatacagtcaatgcattgtaccacttggaaagttgaagttaattatttgaaggaaacatagcaggtacatcaaaaaaataaatgtatactgtcaacaatatattccacttattttgaagtgttttttgaaaataacaaaagccttactgtttactcttatttatttaatgagtgaaagatacattctgaatagaaaaaaaaagagagattacagcctttaggagtgttttgatgtgttattaattgtgctttccccaatcacaaacaactgtgattgttctgtccatttggagacaactctcagactgttgttgaacttcagactagttgtcggaaagctagcaagaggaaaaggaaaaaataaaatgtggctcatgttcattattaactacataattaattttataactatatgttaacatacctctatgctataggtactatactaattacctctatattaactatatatatatttttttagatggagtttcgctcttgtcgcccaggctggagtgcaatggcggggtctcggctcacttcaacctccgcctcctaggcttgggtgattctctcacctcaacctccctaatagctgggaccagaggcgtgcaccaccacacctggcttatttttgtattttttgtagagatagaatttcaccatgttgctcaggctggtcttgaactcctgggctcaagcgatccacctgtcttggcttcccaaaatgctgggattacaagcgtgagccactgtgcccagcccaatgttagttcctaggtcacaagacatacgaagttcaaagagatagtcaatccagatagaaaaaagttataagaacaaggaataaaataataatgatacaaatgatattaattatacctctgctatagtcctgacattgatttaaattgaacaatatcgattgcctttgttaataggtaaaaacagtataatgaaatttccatgtggttcaacctaatccttgctaaaagttgtacatattgttttgtccttacagagatcattttaagtagctattcaggatttgagtgagggcttttaatacccctatttacagatgtagacactaaggctagaaatcttacacagcttgccaagggtcacacaattagttcatggagaggcctggactcaaccccagacttacttgagtctacagcccctgctggacacctgtggtcagaatagattgtaaccacctacttcatagcaaaatctgccccctccagcccatggctctgaagtgccctatactttcatcccagatcagtgctagggtgtgacttgaggtaaaggtacagaatcaacatatccctatactctacttttcctttaattttgatgagtgagtcctggaaattgaggttttttcttaatgtgcaaaatcagaaaagcctcacatggggcttttgaaaggattctccaatcctcaccactgctcctaaatgtccatctgagaccaatgattaacagttcagctccttagtgcctcttataaatgtctctaatgctgtcttcagaaacctctgaaatggatcatttatttgcttcaagtaagtttgcactaagtgaggccacagtatgcatttgtgtgtgtgtgtagtcaagaatacctgttattgttttcccctgttgaactatgttcaactattttgttcaatgaaatcaagcagttcatagctttgcaatccccacaatctcattcttcttttccattttccctatatctctataagatcaccagcatgttaaaatcacaaggttgtcttagatgtgaaccatctaccttgctgtgcatgttgagtcccatatctatgccttcaagggcccagtgaaaactcaagagcttataagatgcacagaaagagtggccttttctgttttgttttgttgaatgctgtattcactgggcctagaacaatgtctggtatgtggtggattttcaatggttacaataaaatgagggagtagaatgagtaaatgaatcaacatgttttctgccatacgcttccactaaatagacttacctttccttttgagttgtccaggaagaggaaacagcatgtacaatggcagtcaggcaagaattagcatggtatgtttggggagctcatcagttttttaaagattgaacatggagtaagctaggtagggtgtgtgtgtgtgtgtgtgtgtgtgtgtgtgtgagagagagagagagagagagagagagagagagaatgaatctgactttggattttagagacattatgttgagaagagtgttaaaggttagagaatagggcaaataaagaaataggaaaaccacataggggattactgttcaggtaaaagaaaatgaggactgaaattaaggcagggacatgggagggtggtaccttgaaaacaattaggtggtagaattaatatgaagatgacaaattgaacacagaaaataagagagagatcaagactagtttgtttactcaggaagccctaaagatgctgaacattctgatatgcattatttatacattgtcttgagcaatattaagggagtctgctgagagttaagcatttggggagtgagcaaggatattgaggagaatgacggaatctagaacaatcacttggaagccaagtaaaaataatgccaggtggcactgagggtccaactgaggttggtcactgtgaatttgcggtggtgccaatctacatgtcaatgtgggagttttccccctcatatcaacttaggtataaagcagactgtgggattgatcaaggtgaatgcatttgagggacataggtgtcataggataaggtatcagggaaattatggttatcagcaaatagaaggtgtcaggaatttgttatgcttgcatcaagcttaggaagagtcactgcatgtggtgatgttcttagtttgacaagataacagagtccctgactggactgagtctcagtagatgacaaagggtgggaggggaaaagggatgtggagtcatgtgtttgaggttcactggtctcttccacattgtatctggtcagggtgtctgcagtgacaccttttaggctgagagtcaccattgaagatgtggtgacttcagattaaaagatgagattttgacaagctatggtggaggtggaggtatgtgaggtccacacaaattgaggtgtttcaataggagacatggacaaaggacctagagccccaggtgaataagtggattcaattcaggtatttgaaggcaccaattcaaatagggtagctgaggttacagaggagattttttgtagagaggatgtaccactacaggaaaaagttggcccttactctttcttttcctgactcagtttaaaattctctgctccatttcctacgtctggggtcttgacaagatatcatgtaaatctacgacgtagttgtacatactctacatctattgtgacatatataacttttaacatttaatgcataaatcttatcccaacattctaatattctctcaacttttccaggcaggtttaagatctgatttatctgtgtgtctcctgattgtttgcaaacatgatgggtcagccaacaggatgcatctgattctctgggggactggttacaaatataaattcctagaacccctaatcccctccttcagtagggattctgatttagtaaatctgtgatgtaatctagaaatctgtactttaaagcaaacttccaagtaatttcaatgcacactgaggtttagaagcaatttcactgagcccaggctcttattatgcctagtagatcttcaaaacagacttgttaagtgaaaaaagatcactgttcagtgctgtttctcttatcagtcaaataagattatattaggcaggctctggtggattagaaaggcatgaggtaaactcttgttgaaaacatgggcctggatatataaggtttatgatgttcttaaataaagtgaagggctttagctcagtggggggacatgcttttctcaacctattccagcaatgctgatgtgactaacatagaaaagcacacttttaaagccacagatttcatctttatggccacagatttcatcttgatatccataaaacagttttcaaaaacccatgttttaggttactaggaggatcaagcaagaggatgcagaaaattctgtgcaaaaaatcatgacaattatccacaaaagaactgaaggcacattctatttactgcttctgggtttgttgtgttattgttatacatgaagaatagaatccaagtgtaatgcactttaacaaatataagtggatatatgtattcaaatacatgccatttttacagaccctttgcttttctgttgtagaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtaatctttcattcaaaacacttatgtggttggaatctgatttatttctttagcaggcacacttggaatgcatttgtttgatcacagttttggtaagtgctacacatggtgaactactatgaaatgtgttccatctttatgaactatttgtagaaagtttagtttctaaatgagttggaaatatatccttcatgttttgagtaaaatacatattatatatgtggggaaagtaaaaaatatatagctttaactaatatactattacgtacttaacttttaatgaagtcatccagttagagtcaaagtgagtgttgtcagctgaagactgctgaatggctaaggcggggtagaaagggcacaatggaaaaccaatcagatgtcctgcatgcataagtgagctaaatactaacagtgaaagaaaacaaatgactgtagctactagaaaaatgaagtcaagttcagggtaagagactcagtcattacaccaattgtaaaacatcattatatgttctgtttttaacattctaggtattatctttgagtgtgaaaggtcagagttcacaactcctgactaatgacaatgaggttctctacaggatttatgctgctgagcctagaattattcctcagacatctctgtgtctcctttggaatcaggctgctgcaaggtacttattaataaaataaaaaaatcagaatttggtccttccccatttcggtaccactgagcctaatgttttgtactgagcatagatggtggccccagatgacattagactggaaaataacctccacaataaataagaggaagcagcataggaaatggtctagtattgttctgatggcaaatgcagcccagcatttcaatatgtgtgtaacacattatttacttcttcatttttactactttcacgggatgtggcatgaattctgctcaattctgataaccttgaagttactagtaaatttattgggcaggaaagaaattccttcttttaccctttccatctgggcttgtggttctggaaactgatgccttgtgtttaagaagaatcagcaggaatttataattctagtccacatggcttgaagtacattttgagattaaatccatggacacaaatgggaaggaaagaatgattctttttttgaatctcctcggcctcaggcctcaaatttctgagcagttacagtcactaggagctcagtcaatgctgcaggatcaggcagtgctggcctagaagggtctagggttcctgtcagccacttgattttgtttattactgaatttcagccacacaaactaaaattctaaataggtttaatacaatagcttagtttggtaaccaactttcctcaaaaacactgaaatttctgctttctttctcttaaaaaaattccacttgaaatttcttcctaggtttaaaacaaatcttaaacctaataaatagaaatactctgaaatcttcaatatataattaataatgaatgtttcaagctgcatctggagtttgggtaaggaagttttaggtccttaaaaaagtaaagaaattaagaggcattttaagggaagaggctcaagtgatagtcactgaggaaggctcagaaggcttggcatcagatacaatgtttgctaaaattatgacatggtttttctgctaaattagccagaattcataaaggaaacacttttaagaaccttagaaaacatacacataagtcactccaaagtagaaaaaaattgaggaagaaatcttagataaccatacaagtaatttatatggttcaaaatacaaggacttgtggaagaaaaaaaacaaagaagagtaaacacatatcacagccatgttgttcttgtgtgagttttgaatggtagagaagagtgccttctattgagcatgtcgggtaggtttgctagattaggtaggaatttgtactgccctgttgagaggacaagctcctttggtaccaggaatgccttcaaagctttggttggtatttaggctgcttcttaagacatcctgtggaatctgtcatgtcatgtcctggacaagatgttcccttcactgtttcttcttgaaaatgtggtctacttaagtcttgagcaaagaacacttaatttcagtaagctatttttctttaaaagccatctcaacaccttcagtattgatgaaagaggaaaaatgactattgtgtttttgccctagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtcagtgacagtatttttgaatcaatggttataaatatttatgaaaatgaaagtctgttttcccataatccttttacgtatgcaagatgcaaacataccgtaattcatcagcactagaagaatacaaatttttcgttgtcttagtcattaattcattcaacaaatatttatggagggccatctctgtactgaggatacagtaaagaatgagacagtttcaccccataaagaatatgtaatacagtgtaggatagaagctagataataggtaaggaaaggctatagtttacagtaccatggtttagagggcaggtactgcagttacaatgtgaggactatgtgagatattaaataatacatacaaagaattttcaaaaaaatacatgcaaagaattttgtgcttttattgtttttaaagctacctcatgggtagattttgtattctacaacttaagagttgtgaatatgccaaccactgtgttaaaaaataaatcatctttcacattccacatctaggcctcatatttggcagtaagaagaaattaaattgtattaatgtctgtcaaactatttacccaacaacataacaatagaagtattattatttgctgtattaattatatggtcgggcatctgagaattccttaaactataattctataccccaccctcacccattctgtgccctgattctcttctttcagccccacaactttttctatgaacaaggtgctatacagtgaattaaattaagagctgggcatagggtaatggttaaaaaatgcaaactttggagccagactgcttgggttcaaatcctaattatgctgttagctagttgtgggacctggatcaaattacttagtttctctgtacttcatttttcccacccatgatatttgattataaattgtgtctatgtaacagggtgataaatatatgaagtcagacatttctaacattctgctttagtgatattttgtctgtaaatgtgattattattgaatgcatatctcttgtatttggtatgcaaacagtctctctaatagtcattatcttttaggaagtttatctggagatagaatcaagtaattaattactatttgttctggttgccagtctttccaatataactttattttatatagttataaattttctttaatgtattttaattctgaacctaacttcaattcaatagcaagataataacttcttattcttaatatctttcataaaggatgacatttcttatttaatagaatcttctaggtccacatagttccaaaatcagatggagacatcctattttacttttatgctaatgtatttaaagagcaaagaaattttatagaatgatgaaataaaatcaaaagatataatgttgaaatacaatctagatgtcattttacatgtttccatagaggcataggtttatgtgctgctatgacccacaaaatcccttgcttgttcccaaagactgaatataaaaaaaaaaaggagttttaaaaactaaagagagaatgttatcctgattttatagaaaactagtaggactgaatataatgagtttcctggagaatcattaataaatacctgtatatcttttctgcaacttactctagaaaaggctacatggatttgctcatgtatttgagaatcaacacctaaatgttagtatctgcttttatcacttttgacttggagtcatatttgaaattattttattctctctgtccatgtcatattgttatgtaattgcatgttctgtcgataaggagacacaaagtcttgtctttgtacctcagtttcagctcatccctcagggctggatgaattcccatccctctgatggatccccaggaaccagaaaagagaattttatatatcttacatacatattctttatatatcttatatacatattctataatttaggtcaagacacattgaatatcactctgaacttgatagaacttggctagtacttttcctgaaatacggcagtatacaattagacaggaatttaacctttttttaaaaaaacagagtagatcacaatgtatcggtaccaattctagtttgcagttctatttactatactagagcagaactacccaaatgatcaaagtgtgtcaaatagttgtagaggccaaaaagcttaccacttctcagcttagaaagatgaaagaaaagggcatatacctgtgacttaaaattgtaaactagtttgccaactatcagaaaattaaactaagatcattccttgaggttaaaatgaaaggacaaatcatccattgctgtgggcattagagtgcagcattatggaactcaacacaaagatggcttgggagaaatataacaaaataattacataataaagccataattttgtagtataattattaagaaacttcagcatggtttgagatacacattgctattttgaggatgtcaaggaagcctactctgccttcccataactcttttgatattgtactatcaaagataaggctattggttatgctactgcattgagtttgactctgaatacaagtcttatagtcttgtaatcttttttttttgagacagagcaccaccacacttggcaaatttttgtattttttatagagatagggttttgccatgctgcccaggctggtctcaaactcctggactcaagcgatctttccacctcaccctcccaaagtgctgggattacaaatgtgaaccaccatgcctggccaatatggacatattatttgggatgaatttggctacaagtaacagatgatgactcaaagatatcttaaacaaatatatttagttcccagattaactaattcagtgccttaatggtgttgtcagcagcccaggctcttctctttttatcctcaaggatttttttccctcagctttgtttgtacatggtcttaagttggctctagcaactctaagcatcacactagcaatgtccaggcttgccagggggaaagctcttgagtccagttttaacagcagtgagaactttctaaaaagccacccaaaatgttttcccttgtgtctttttgatcagaattatattctgtgtgctttcataactagtctgtgtcttggagaagatccagatagaaatacagagagacaagcactgaaagagcagcaaggatttatctttccgaacattgcccagcagtccctgacatatactagttcattggttgttttgtagagatggtgggagtgaggcaagtgggcgcaggagttcctactatattgctcaggctggtctctaaaacttctggcctcaagcgatcctcctgcctgaatctcctaaagtgcttgagttacagctgtgagtcaccacaccagcctgacatacagtaggttttaatagatattggttaagtaaataaatacacagtattgatctgatgatatcctccaataatgagatgtatttttgctatgtgtcaagttcatactttcaagtgccataccatatttttctagccatttttaataaaaattattttatttatttattttgagatggtgtctctctctgtcgcccaggctggagtgcagtggtgtgatctcggctcattgcaacttccgccttctgggctcaagcgagtctcctgcctcagcctcctgggtagctgggattacaggcaccgtgccgggataatttaaaaaattattttaaaatgtggcatattctttcttgccttcacttaggatagtttaacacaacactctccaatagagttttccaggttgatggggatattttacactgtctagtgtggtagccactagtcaccagtggtgactgagcccttgaaatatggcttatacaagtgcaaagatgaatttttaagtctatttcattttaattaatgaaaatttaaatttaaggctgggtgctgtgactcatgcctttaatctcagcactttgggaggccaggagttcgagaccagcctgggcaacatagcgagaccctgtctgtacaaaaagtaaaaaaaaaaaaaaaaaaattagccaaacatgatggcacatgctgtagacccagctactcaggtggctgagacaggaggattgcttgagctcaggagttcaaggctgcagtgagctatgaccatgccattgcactccagcctgggagactgagcaagaccctgtctcttaaaaaataataataataataatgaaaatttaaacttaaatacccacatgtgactagtggctattatattgaacagcgttaagttcaaccaccctgtttatctggaggctagtctcctggcaacctcaccactctagaataactcctttcccctaatacacagaacttttatactgtaaaatgcttcgtactgacttttgttcatactagaaatctttttttttttgagacggagtttcgctcttgttgcccaggctggagtgcaatggcacgatctcagttcattgtaacctccacctccagggttcaagcacttctcctgcctcagcctctcgagtagctgggattacaggtgcccgccaccatgcccggctaatattgtatttttggtagagacggggttttgtgcctttagcttattagtagcagtaaccaaaaggcattatgctgagaagagagttgcagaaacatgggaatcaatagtgataagcaacaaaaagtacaaaaagtgacaagcacagcagttaggttggtgcaaaagtaattgcagtttttgaaattaaaattaattaaaattgttgccaaaaccatcattatttttgcaccaatctaatacattaggtggtataataaaaaaaaaaaagcctaagctaaaaagctaatagtggatttaataatgaaataatgataatttggttttatttggatttatctgtagagaaggcagacagataaacaaataatttgtaaatattttaaggaaaatttcatgagaaaacgtactaatacttgtcttgtgaaagagtaaacttaagttatttggaaagtatctctcattcttaagtgatgccaaataatgaagatgtttataaacatatgtaatgtatatatgtaatttatgtacaaacatttcatatgtttatatgtatacaaactttcaaatattgtagagatagataagagaatctgtagtccagtatgataataaaagactttagctgttctttaccaattagatgttcttttagaaccgaatctctaatccacatagtggtaggaaaaaaaagaaaaggcaaattactcaattagctgcttgttttatctacatcattgccaagaaatctgttttttaaaaaaactgttcagagtatacctttaagtaatacctggaattgtgatactttattttttaaaatttttatttatttatctattttttttttgtttttgtttttggaggcagagtcttgctctgtcacccaggctggattgcagtggtgtgatcttggctcactgcaacctccgcctccaggattcaagcgattctcctgcctcagcctcccgggtagctgggactacaggtgcgtgccaccatgcccggctgattttttgtatttttagtagagacagggtttcaccgtgttagccaggatggtctcgatctcctgacctcgtgatctgcccaccttggcctcccaaagtgctgggattacaggcctgagccaccatgcccggctatactttattttttaaaaaatcattctatttatagttataacactttatgctttgtaatttgcatatttatattaaggaatttcaaccaaaaagtttctgcaattaaaaaaagatttctaagtttaaatagatgttaaatatagctatttaatttcagatgaaaaaataaaagataagtatttagtatatagtgtcttagaaacctgataattgaaataattgtttctttaaattttaggtattcaatatcctcacccaagccagatgagtttccctagactaggacccagcctgtttgaggttttatcaatattattctcccctacgtaaaaaacgcatctagataactatgatgcgttatagttataggctggtagaatctcacctatcttcctgccactggctttgaatcctgaactgccaccaggtgtcatgctagcattttaactgaagcctaatatacttaattaaatatttctaagctggtcaaatttagtatactaaatgtatatcatgaaacaggagtataatagagcattactaagttaaaggaaaaggctataagtaagctcttcttgtgcactagaaaaaagttgacttgtgtatgtctccttgctgagcactaattccttgcctcacattgtcatcctctaccacagtcaacttacagcagagcacatatttgtgatcatgtgccttaaaatgaaaaaaaccttgcaaggcttgctttaaagtcagtatattactcacacacacacacacacacacagacatacacatgcacacatacatgcacaggcatgcacattcacacactcaacttaagacttgaatttaagctggcttttatcatcctagggaattcaaagtatgcattacttgagttctgagcatcaactccagtagtatatagactacctaagtcaagatgcacaatatctagcatgactctgcagttcctgaagatacactctgtacttgtgtgggtgaattttgaagccagacccaggacctacacacctgttccagaacaccccatggaagccttcccaaaaaacggattgctctagatttcttggccaaatttctaggccaaaagccttgactaacgcaaagcttcccttgttgtggagagccttgtctaccttgttaaaatttaaaaatataactcaaatggtttctcaaaaagaagttatgagaaaatgagtaacaagaccccatgtggaccttttgcagatgcccagtccacttatgccaacatgcagtgtattctgaaagtttgttccacagcttcaaaagaaaacaaaatgttaaatgagtgcagtgcctcctgtttattaacgaggcattgatataactaaacgggtaaaaatgcaaagcacatggcaaagcagtatacatatgtcaattgctgttatgtttcagtaatccttagacaaaataaccctactgagaataagagtggggtaaaagcttaagtgaaaaagcaaataggttatcatatgcagcacatttaagtcttaaaaggcagaaaatatttttaaaacacatgtataccctgcctttaaaaatctaacattaaaagaaatttatatgaattgcaagataaaagatttgttggattagtgctaaggttctaactatccctttgaagtagtgtaaacaggtgaattcaaacaaactcaaagataataagaataattttcttcatacaacttagaaatgtagaagtttaagttaaaagtcattgtggagaaaatagcacactttcttcctggtttgggcatccagtattgcaaagttgcctttaaaattcataactaacactattgtaattacagaactatttctagtagataaaaaaggggtaattaccaaacctgagttttggtaggaccagtcaaaattttatgactgaaaaatcctattcacatgcctgaatattgggcttaactggtaagtgtaaagatcttacttgtcatggaaaatggagtagattacaattgccatgtcatcttttccagaggtactgggcagaggcaggtggcagacctgacatgcctagctgcccccaaagattcttgctatgatgctgttagaatcttcatggattattaaaccatatgtggacttttttgttcctacaggtctttgcttggctgttctttcccatatcttctgtgccaggtactccatgtttgcagctaaacttctgactcacatgatggcagccagcttaggtacacaggtaggagagcgctggcatttttgatttatcgtgagatgtttgtgtttcttcttctttggttcttgaactgagtgtaaaagtaaagtttaatctcaacttagttgaaataaacttgtttagttttgcagtggaagagaatggggacaggagagtcatataaggagaatcaggcctaaaatgcttctttctacagagaagcaccttaatatcatcgcttacaaaaaaaaaaacttcttatcacaaagcatcttattgtcagctaatatatgctgaatgtatttgtaatttatatatacattaaaattaacattttattaatctgtttgaaatatgctgtgttataaattctttatgtttagggcattaagatgatataaacttttaaagcatctggacactatgtattgtttcttataatagtttgatagaacattttcttttgaaaaatcagttttctatggtagaagaaactgtgtgaaaaacaatgacttattagcacacaatttaaagtatctagtttaaagcactgtgtaaagcacagaaaccagaacaaaagatgaaattagatgctttttctatccatacggtgttcatagtctagaaaagtagatgtacatataaataactaattcagtgtgatgtgtgaacatagaccatttgcaaactactctgtgaaaatagatgaaggcttaattcatttttttcatttttctctgaaggtcaagaaagtcttcatagaggagatgatattgagctgggactcaaatgagtgaaaattcagtttgttgttaaggactaaaaagggcctagacatttatataggcaaaggaaaaaaagcataatcacttctactttaaggctgaaattatagatccaggcagaaagaatattctatataatgctcttatggagataatttttaatattgttttataaaattaaaaaatcccacttttctggatggggagacacttctgcaatgcagacaatactctattgattgggtgctggtcatatgtgtgtattgaatttgtgtgtatttattgtgctgtagacatgatttgcacagttttttagaatgctaaagtgcatttattgaactctggatagaacttgaaaaaaatagcgtttgtggtggagctgaaatataaaatggaaaattatcttaaacattgggattctgtcacccttttttgttctaggagtgaaaatgactgtaaattccataactctgtttttcagggaataattaagtgctggattctaagcagaggtctctgattggttttttaaaggccctatgagctatgagaagtagcagtggttaccaaaggggcttgctttgaatttcacaaggctatttatattgcctttgtaacctgccttagctgtctgatctcgcctttgcttcttgaatctaagatcttagaaaacccgccttccataattagagtttacttggctttattcaccacccactctggtgattttttggcagcagaatttgtacaagacttaattatagcactatagaattacagacagctcttcagtgtcctagcagacaaatttgctcgtgtctagggatgtgaaagacaaaaccaggatttctatgttggagcactgacttttgattcatattgtacttaacattaattttggacaaaacggttagtcatatccatgtttttcagtatatttttagaatacatgaaacaatgtggcatgaaaaatcatgtagtgtatgacttgtgacatgaaataactaaaaaagtattttcatagctcttttttggcaggaagaattggtatgttattgatagaaaatagtttatttcaaaatgctttatctacttagatttaacaataccctctgagttaagaatagttatctcccttaaaaccttttagctaaggctttaaaaaattcttagaccccccaaaacaagaagctgactacagtaagttgggctcccaccctatctaaattttaaagtcatgtttatagctccagttatagaatcttgccaacaggagttattacagttccagccttggatctttcatttgggatcctctgtcaatgttatattgtcatttttggaggttaaatcaactctagagaagtcttaaaaaaatgcaggcttggcctgtggttctttagctaagagggaaaattctatagctgacctagagtgtttgagttgtgaatactttgcagacaagtctgccaagaccattcattttcaaatctttattaatgaactaggactaagtagaacggcttttgtggagaaggaaagaatggaaatgtggtagtcctggacttccttttggagcagtgtggtataatgggtccgtgaatcagaaagtcaggaaaatatgctcgtccagctctactttctacttctagaaatatgtagactattataactataatttattgtgtatgtgtatatgtgtgtgtgtgtgtgtgtgtgtgtgtgtattttcttgattggaggaatatagatacaaatccaaagattattcctgctttaaaaatcaagattctgcttgaatctggagtttgtcattatagcacccttgagaatcattgactataaaatatcagtaggtggcagtagaagatttatttttctcccttaaatttatcgatctctctttagccatgatggcgttcagtaaaaaacttgagagatgctttcatagtacttctttaactgggcaagagggtatttgcagcatagcaaatacacatttgtggtgtcctacctttctctttttatcctctttattcagaatttaattaaatgcaaatgtaccataagaaagattgtactccactggctttgaatatatctttctactgcttatatatgtttaaattcagggacataaaattagcttcatcattatatttatgagcattaagtgtgttattgatacagaaaaatgtttttattatgtcatagaagctttgagataaaggtctctattttcagtttatcaaaaaatgtacatatttcttcaataccaagttattttttctcacttatataaatgaaaatgattaaatgacaagaaattgtggggctcttcaagtatgatgtgaagaaacagcaaacaaattttcatggtattgggtgatatttctgagaaaaacatctaattatatctttgggatttttatctttgaatcacattgccaacccatgtgtgccctgataaggctggtaaacaactagtgacaaagagcaagtttgcagttcagggttctcagttctggaggttctgtcaggaaaagcaatcctccaaatctaaaaaaagaacagaagtttcctcatagaaaacatgatgaaaagatagaactgtatttactctgattaataatacttaacaagggaaaatatttgtttttcttctctatggtttgttatttgtacagcataaacacattttctgaaactaaatagcaaattcatctagaaatgtgtataagtccgtacattaaccgcaagactatagcttaggggtctattctctggaatttaaaaaagttggactgttactgtcttttgatcactttctcattctgcaacattttgggatgtcattttgcaatgtcctgtttcccagggaggatcctactcagacacccttgcgaaaagattctgctttaatctggaattatgtcattctcgctttgagtacctagcatctttgggaatctttgtgcatgactaaaggcagaagtcctgtgtgacttcccaaatgctggctccttctggatactatgaatcctggtttctgttccagcagcttgcgctgctttgttgagattgccaactcaagaaagtcattgtgtgagtaaggcttgaagacacatatgtaacaagcatattttaatcaactgaagcagagtaagatagagatggtaaaatgttcatcagtcagaaaagaattttccttagttggaagtttttgttaatcacttattaaccagaatatcctttgttatttctacttttttgctgaataaaaaagtatgtaagcgtttaagtacaaggatcaaaattaaatcttgctttgaagattaggaaattgagaagcagagggtcatttttcagtagaacatttatgattatatgttagtggagatataaatggatcaagaaagtagcaaggaaagtgtttcctaaacttcaatgcaggcatcttgttaaaattcaggtagtgcatcagtgagtctatggcgggtttccggatcctacttgttaagtaaggtattagattagctatattatgaccccaaaacatctctggttgttgttgttgttgctgccactgttgctgttattattattactaaatccatataatcaagctatttttcttagtatgaaattttatttaagaaatcccattaattaatttttttagtttcatttcaaatattattgcctttaaaacgactgcacacttgtatctttccctcattaatgaaaggctgctgctgtgtccttctgattttttttatttcttttttctaagaaagggaaaggtccttaggcaagtggactaagagataatttagagtatgaacaaggcctttattctggtcattctcatagcatttgacaatttgtaaaacttctcagtgttgttttggacataaaataaactactagaaagaagatataactagttcccctgccccaagttcattcttttctaccaagatcctgtaggtgccctccccccgctagaataatattgagtatgtaagcctttttttttttttttgtacaattaactgtatttaaatgtgtctttatgtagagattggggtatttaactgtatcttttcttcatgtagagattagttgggtgaatatgaataaagacattctgcacacagatatgaatatacatttaagttgaatttattaaactatttgactcaatttaggtatgctcaatggcatggtgaaaatattattacattcatgactgagtgaccattcaacattcaattgtgaaattaaaccaaaaaactgagccagacccgcatctcaggtcaagaccattattcatccagcagttcgaccacttccatctcatctatcatatgtacaatattaagattgcgcaatgagaaataccaagcaagatgcatacatgcacacaaagcgtgtaaataataacctaaagcactaacctcatagtaagaaccaagtatatacagagaaaaaaatctcttcctctgtagtactgcataggctgagaataagggaccccagtttgcaaagtctctgtggaggaaatggaatctgacctggttgttgaagaatgtataagatttgaagacttggaatgtgacacattctaggcaaggaaaagaacaagaacaaagacatctaagttatagtgatcctggctgctttcacttgagtaaggcttgcagatcccacagagaaataggtaagttttgactgcaggtgaggcagcttcccattgtctgagaaccatgaggagttacagagtcaccaatggagttagtccaaaaagtcacaatatgaaaggagtatttttaaggattgatctggcaatgaaggattaaaggaaaaatggactaaagaaggtaagagactctaattagggagagtagagaggttgggtggactgcttttaccatcatccgattaggatgggttctgagcttagacagtggtaatggcaatgagaattcaaaggaaggaataaggactaataaaaatatcttattttgccttattaaatttctgcacttttcttgtctgtctttaaatcaataaaaaagccacattgcaaattttatttactaaacattaatgtaatatttattacatattacaggaggtagagattatgaggtaggtactaatattattctcattttacagattaggaaattgtgacataaagagtttaattacttgccataggtcacatagtggtaagtaacagaactagtatttgaacacagcagccagcctccagtcatttttaaaactgctatactaagttgcttcataaatgaggaattaatgaaatttactctgtcaccaaatgagagagaagatttttaaggtgactgtgaaactagtggtttcatttgacttaaatatgaaagtggaaaggtttaataattggagaacgatatgtgcaattttgagcatgaggggtttaaggtttccatagcatggagatttagatgttatctacataaatgtacagcttcttgacactttaaaataggttctctgagacaggttgggtagagaacctgtgtatatagaatacatataactaatgtcattaagggctgggctttgtggcactgaatttagtgatttacacatattgcattatttactcttataacaaccagatgagatgggtactgttatcatccctaaagagactaagagatattcagttacctaccctaacttacataggtagaacattgaaggaagaagaatttgaagccagatgtgtctggctccaaaactcacgtatttagagaccacgctatgtggaatgagaaggatcactacaagaggattggaaaatgttaaagtttttgaagccaaagaaggaaaaaggtttcaaatggaaagatttgagcatcatgaggagattagtcctcaaatttggcaagaacaaggtccctggaaacttggagagaaatgatgaaaattagaaaaggttaaagagtaaatggataggaagaaaatggatgaggctaccagaccacacctgtgaagtttgtcaatgaaagaagaaggcaatcaaagcacaggaagtggggaacaattctggtggctctgatcataggtttgctgcagggaatctgggccctggggctgccacacaaggggcaggtctcccccatctcctccactaatattttctttccttgaaagagaacttcctgttgaagtttgttgaaagggtaataggaattagtaagtttctctttgatccatgtgtttatttatatgttgtgattaatttgaattttttaggtctaggcaagtgactccctgctaatgcacctaacttaatcaccttatatctaggagaaaattagagctgtagtttgagctttctttttgcatttcttgaatccaaatttctgtgatggccttatatttttggtattgttactattgaactttatgtaaacttgcaatcaatcatgaaacaaatttataattagcaattatcaaataattatataagtcattctacaaccaaaaatattaatattatgctattcacaagtgtgtgctttggaggattacaatgattttggtactcaaaatagagtgaaatttgcatattaaggtattgaattccccaaaaaaatattattttatttttgctttctttttatttaaggctacattttcctttatgtatcaaatttgtctttcttaaagtctcttaataataaaatcgaattccttttcctcaacaagctttcaaaattcagctcaaatagactgttctcactacattgaaaataagtggacactaaagatacaaaaatagtatcatggtcacaatactgggaaattcagactttcccaagtgctgaagtagcaaagcaacagaaagagtgagtaatattctgaatgaggctacagtgacattatcatgtttgcaacatagctttcgttactaggaaaatttgtgaggcaaatccagactttaccaaaaaataccagtttggaaccttttattacagcttcagtaacataaactatccttgacctttaaaagccttccttccttgatgtccctgactaggcaaaagcaacatatgaaaaaagttgtttttatgaatatttaatgagagctctaaagaactgtaacagatatggagcgtagggggaagtgtctcagttttggaattagagagactgatggggtaacatctgtcaactacagtggaaaaaaaatcactaggaaaataataagaatgcctgatttgcagcattgttgagaagatacatagtggatcatgttcaaatgcccaagacacaagatccgaggaaggagatttcagaagaggagggcaaggaggattcctgctacctcacgacatgcagaggcccttcaggttctgccctgagttgaacactgaatccttccagagaacctgagcccctgagcctgcttttctgtgcttcaggctttcttaaatcagctgcaagggaggggagaatttggggccccaccctttttcaataattggctctgtcaagcctgtaactgtgcctttccttgtactataggtaatgtagaccatgaaatttgtttccgttggtctgcattatctgtaatggacatcatcagtaattttgtttatagtttttaagagttttttttccctgatctgagtattttctaagtgtttgtgtcctcattgcttgtgttgaattgttataaccttaaaaattggatatatataatatgcttgcctatctagaaaattatacatatggtatgagcttgtgtgtgtgtgtgtgtgtgtgtgtgtgtgtgtgtgtgtgtgtacatttgaaatttgaaatagacttatattttgaaatacagagatacttggctccatagctgaagggctagagcactggtcttgtgaaaatacagagacacttatttaatgaaacagtactgctaaggacgatgataaacacttgataagttaattccagcactctatggcatagtcagtatatgtattattgcctctgcattgtgtgtaagaaatctgagacactaaacaattctgtgacttgccccaggtctcagatcaagtaagtctatctccaaagggtgtttccataaccccttctccacccctttacagaggagccctcagagaccccggtagtgcttcttccctccacttccttggagcctaatagcatggtcttcttgcagacagttttaacatttactctgttactatagtaagcatgctagaactaaagacttctctttagtttcctttgtaactctgtgaaatcttgcttccttctgtgaaactttttaatgagtggtccttacaaaattggtttttagatttacattgacctaaaccccaggaagttgtgtctcctgagctttatctgcttgctgtacagcagagtgccttttatgtagttgcctacctgcctggctgaactttaagctcccaagggaagaaactgttctttttcatatatcacatccaatgccaaaaggtaaaagaccaaaataacatcagtcacaaagacagggcagcctttcctataggctagttgtgtgcagtctagaactgcctttctggcagagccctattcagataccatctttcgggaacatacactctgtgttctgccaggatgggggaggagcttggtttcaggcactatgttttggttgtaagggcgaatgttattgccaaactgaaacatgtcaaatatcaacaaccaagtgggttttgtggtcacatttcatctgtagatgatggcatgtgcaagtgattttatggggtttgatgtggaaactatgagaaattccacaactccagagtgcacctctaagccccaaccccccgtttattctcgctcttctgcaagacagagatcaaggttgaatgaaaatcttgagtacaaattctcaatttttgcatttttaaaaacttttaaagtatagatttctttacaaaaaatgctcagagaaaaaaattaaaaagccaggcatggtggtgcacgctgtagtcccagctgctctggaggttgagaaaggagaattgcttgagcccaggagttggaggctgcagtgagctgtgatcacgccactgcactccagcctgggcaataaagaccttgtctcttaaaaaaagaaaggaaaaaaaaaaaccttagttaaccatatttgggaattaaatgcttttctactgtctgttttttgggtttatcccatttgtgatcccttctgtcaattgtcaccattatcttgctcacctaagccacctttcttcttttatggactccaaactcttccctgtggtcttaacctgacccctttctccatagtctgttctctcagcagcaggagtggtccttttaaagactaaattgactctaatcattttccctaaaactttttggtgtcttcctattgcacataacagagggactctgacctccatctccctcaggatcagtctctgcccattctctgatctcatcttctaccacctccccgttcacccagcacagccacagtgggcacagttctttaaatatgcccagcttcttcttgtcctacatcctgtgttctagttaatacctaagcctggaaagttctgccccagtgttttgctcatccgtatttccatttatacagcattgactcactcaactcttacgttaccacctcagagtggcctccgcaagaagacccacccctacggggtctcatcactgttatgtttattcatatcatatatccatatctaaattttcttgttcatgtattgtattctgtctccttttcccctttctaatggaatgtcaactccattagatcaggaattgcctgtcttgttcattgctgtttctagcactcataaaaagctttttggctcatactagattttcaatttaaaaaactggttaaggccgcgtgcggtggctcacacctgtaatcccagcactttgggaggctgagatgggcggatcacgaggtcaggagatcgagaccatcctggctaacatggtgaaaccccgtctctactaaaaatacaaattagctgggcgtggtggcatgcacctgtagtctcagcttctcgggaggctgaggcaggcgaatggcgtgaacccaggaggcggagcttgcagtgagtggagatcgcaccactgcactccagcccgggcgacagcaagactctgtctcaaaaaaaaacaaaaaacaaaaaacaacctggttaaataagaaaaacaatgaagttaaaagaaatcttaggctttcttataaagagcattcttggcaatctaaaactaacctatcaccattttctcatgaaaataagcacttcctatattctcaattccttaaagcaaaacaaaaccagaactgggtatggggcacatgcctgtaaccccagctactgggaaggctgaggctagaggatcccttgagtccaggagtttgagcctgcagtgagctatgattgtgaattatgatttcaccactgcactctagcctgggaaacagagcaagaccctgaatttaaagccagaattttaaagaagaaattattcatattcttaaatgtaatctgtagtgatctacatcttttataaacaaattgtattataattcttggtttataatttagatgtgttcaatgcagaattaattttcccagaaaagaaatgcttataaagagaagtcaagatctcaagccagccaccaaagcttatttgactcttaatctgtctgactgttctggatcctaattgaatttgtaacttctcttcgtgttaaaacattctgatttctaactgggaacttcaagaaagcccatactgctcccacagcctctgttatatggctcttcttccttcaaaagtccatagaagcagactacaaggaaaccaggtggtggtggggtcaggaaaggtgagatggaggggaagagggagacttctggaaactagcttcctgggtcaggtaggtgctctgcaaataagttggatagcaaatggtaagttttctgaaacttgtggtcacagagtgtgcaaagagaattggctcttcaagcagctttagtaacttattaagaagcaggtttggagatgagagaacaattattggagtacagaaaaagttttcctaagtaatgtctgtgttccaaaggaatgaaattttgtgttaaaatttagatactccaagatagataataactaattgtaaaagctaattttaatagtgttaactagtaaatgtctgtagtgccaaaataattaaaatgggccattaaaatatggctataaatatcaaggttattacattgttagtatgttgaaattgagaaatgaaataccccaacatactgcaggatgtctagacataatgagcaatcctgtcatgtttaggtcatgtttataattgtgattaatctactcttagtttctgagtttattgtatctgataccacactccaaaagccttttaacctatgagtagttgaaagcagtcattacaatgcctggtattttgtaaataaatggattaataagatataacaatcacaaatcctaatcctcctctcagaaatatttaaaaaaactaaaatctttgcatttaaggagcatggttttgtaccttggaaatctttaaattaaattgttggtttaacttttggaacacttttaaagtgttcaattaaatatttattttagaagggcaatataagcatttacaattatataaaaatatccatgtaggcactgctaacacagtttcttcacttcacaggaggacaaaggctgcaggcatctaagagattaaccccaggaagccagagtagctgaattgccagtgttttaccatttattgttaactcactagatactcgtgaaactccattaaaaaatgcccttgtattatacaaacaatccacacttgagcaacctttcactctaagattaggaattgctctttgacaacctttgtcagggttaattattgaagacttttgtgtgaattataggaaagtcagatgaggtcaagcaagtctgtctaccacctcctgtttgagtcttaaagtagcagaaaaatctattctccaggtaatgaaaagaagaccttttctgaaaattttgttgaagcacaatttaaatttatctcatgtttgcagttattcattcattgctcccgttctccaactatttagtgtcatatgtactatgacgcagtaatgtcatgttatgtaaaatatagtaatgacatagtgaaagacatagtttagaccctccagtaattttctgtctaccaggagggtaataaagaagtaaatagatgaatacagtagaatggtgtaagcatataatagcagtctgtacagcatatagtgggaaccaaaaaagagttattaattctatccaggttgaggagtggagtcaggaaaatcttatagcaataaaaatgcttagctgtcttgaaagatgagatgtcttcaccaggaagaatctacatataattaaaagacagacattagtaaaggcagaggaatgggcagtatctggcaggattagtgacgcaaaaaggattgctctaccttggattatgttctgtttagtttgcaaggaatctgggttggttcaactggttaagagctgatggtgaggaaaggagagctactcctgggcagacctgttggaaaagtagaatagtcgccagacctgagcagaactgatgtatggaggagcaacagaaaatgagaattttttggaaagaatttgggttccacagatacattttagtgtctcacaagcatttttttggaaatgtgttaacttgtctaatctgaaaaggctgaagtatctagttctgtactactgcgtatggagaaatggaaagtttctgtctgttaggcatcagtagggtttcagtgtgtggtttttttttttttcatttaatgtctcttacaaatttcatattttaaagaataattcctcataacatcctccagtgaaccctttgtgattagtttaagtgaagagataggaaaaaatagttaggtgtaaggtatattttttcaatgctttttcttttttttaatgttatttcaaacacaatttactgctatcacatattaaagactcacaagacataaatcaatacaactttaccttttgaaatatttaaatttatataaaaatattaacattacctcttacatgccctttcgtgaaattcagaaaaaaaaatgaaactattaaaactgcagctgcatgactatggaaaataaatcgtgtgtatagtttctgtgatattaccctttgtgaatttgctattgaattcatattcttgaggtaaagatagagttcagaccttagaaaaatacagtgataatgccacaggaaaatatttgtggtgttgtttaagattcagcgtgtgtaactcttttctaggttattaataggcttgggaaaaacaatataagcaatttctcctaaatagaagcaagtttgagagaatagacttccgtcagaattggctactgttagggagaaaggaagctgaattcaaacagttttgtgagaaactggaaaagaggaagcaattgagcttcacaatcggtcactgatatttgatttactttctttggagtttacaagtggctgccaagttatgtctaacgcacactgcctaatccttggaggcctctcttccagctgatgtctgcgtcagtggtggccatgagagaggaagcaacttgaagaaaagattgtttaccacttaaatttaacatggaattcgaaggctaacgttaagtggtttagaacaccactagaatgctgttttgtatgtttgtgattcccgaaacagtcacccagcatctagtcctaaatatgaattaagatctcattccgaagaacaccttcttatcacttctttgaaggtaattatgaaaagtcaaagatgtacttctaaaaaatgcctctatgttcacagtcatttatgagattaaacagataaccagctgactaacaaactccaacatagtcatgatggtgtccttaagcagattataatctcaggagtgctggggagatttatacagatatgaaaggagggcaaatcaaggaggtatgaagtcagctacatggtgtagtgtaggtgtcacacattatttgttgttgcactttacactttccccacttacaggttacaatttgcttgaagattaaaaactcgaaccatatttggttgttaattctccttctgtggacagactggaacaaatggcaagagaaacgattgcccagctacatgtgagtcattctttcctgggataaggctacttcagctttaagtggagagtggcttggggaagctgttgtggaagtaaggtcacagggtttgagacatgtttgaagcaaggcttttgttccagttcttccagtctgcatgcaaaaggaaggaaggagaacatctactagcaaaagctgaatgaggacttcaacctcacctccatggttccccacacaggagcagagcccagccaaggttcccacctaacaccatctttccagaaattgttttgagatacataggagagaaaggcccttatattcacaagaaaacccagcaatcatattcatttgaaaagcaatccatatgcacattttggaaacaaaagaagtatcagtacacagggtgaaataaacttgaaaggagatttgtaaagaaaagaacaagcagtattcattcaaaaaaacagaaggtaggatgttatggaagtaaaacagttattttgtttaggtttaaatttttttaacttttaaaatttgtgatataattttgattatgggaatcatagattcctgttatcaaaggaagaatgaccttttcccatttccttttgagtttcttaaaatttcaattttctccttaattatactattttatgctttttttttctccaaatggtaaggcgtatgtttaatttaaaattttaatttaaattattttggccaggcacaatggcttgtgcctgtaatcccgacactttgggaggtcaaggcaggcaaatcgcttgaggtcaggaatttgtgaccagcctggccaacatggtgaaacccctgtgtctactgaaaatacaaaattagctgggtatggtggtgcacgcctgtaatcccagctacttgggaggctgaggcaggagaatcaatcgcttgaacctaggaggcagaggttgctgtgagctgagattgtgccactgcactccagtctgggtgacagagcgaaactctgtctcaaaataacaataataataataattaataattattttaagaagcaatttttagatttctatttttttccttttatttacttaattccagagaagtaatggtattattaataatattcttcttgagctcctgttatattccagagacttcaggtatgctactttattttattctcacaatagtgctatcagtagacattgccatcctcattttatactaaataaacttaaatctgctcatgatcccatagctatgaagcagggctaagatttgaacctatgtgtgtctgattctcttttaaccactaaattacaaacacaggtgtataaaaaatgtgtgtataaatatgtatatcatacatacatgaatgtatgtcatgtacagtatctgctgtttccttttcctgaaaattgctaaaggctttaatcagatagatggaatttgaacaatcagaggtggagcttgcctctcagtggggagaaagcattttgagcaaagaaaacatcagtgacacacattgggtttaagaaagtacaggacatgttttaaaatacaccaaagtaggacattgactgacatgtactatatctttgaatgagagtgttgtgggttagcttgaaaagcagattcagatcagcctatgggaggtcatgaaagcttagtttagtagttgggactttactttccagtttttgatgatttttatcaagaaatgatataagaagatttatcctggagccacctctcagctcagcttctctgaacattgtggaattattatactaacgtgcacaaacttgtaacaatagcagcaaccattccaatatgtcagctttctggagaatattgtccgtatgtcaggatatgtaaataatttcaaatttctcacccttagtagtctcccacccatataaataagcttacagtgaatagtggccagattttagcagtgagttttcctatgtagtccattcctaatcaaagactgcattacaggattcatggttctgtctggtatacttagtattgtaacatcctctgctttcactctttggggaagcttaacctctgtctgctcaatgatgtattcttttcttcatacctggataatgttttggagtacattttaataaaaccagatcatgagggtaaacaccaatgtgagaagcttcattgtgcatctcatctttagttgataattgatggaatattttgtatttcatggatcctacctcagtacatggccaagaaactgctggactccacctgtgcaatttttgaaaagaaattgaatgatgcgttccaggaagggtttgcatttgctcattatttctggcttaatcaaattaaaggagaagaatgaaaaacagctaactccagagcacctgtaaccagtgttgccggaaattatgaccctgttagcttgacattgtgtggtgaaggggtctaattattggactgttaataatattatttaagccctcattaaatgtgctaccatttaataggattttctgatcacaaatcttcattagagtcttagaaagtttttttttaatcttgtatttttccataaattcatcccattgaataactcaagggaggtgaactttggccagtgggtcacagcaaaggataaagattgggtgatgtatatcagggatgggcggaatttgtaatagtttccagctgtctcagcagtattaatgaaagtattagaaaataaatatggaaaaatgattagagattcgaaagaagagacatcaagtatgcaatgtgggactttaaaaaaaaaatacaagatcttgctctattggtcaggctggagtgcagtggtatgatcatagattattgcagcctcaaattcctgggcagtcaagcgatcctcctgcctcagcttcctgagtagttgggactataggctcaacttttttctttttttgtggagatatgtcttgctttgttgctcaagctggtctccacctcctggattcaagcaaactgccggcttcagcctcccaaagtgttggggattacaggtgtaagccactgcacccagcctgcttttcaacttttgaaaacaaaccaacatttataccaaggactgagccagaagaaaaacttctaaatttcatatatggtagaaaattgcagatttcctcacagatgtaaagagattacctttcatattaatatactcaccttcaaacagaaagttatctatagattttagattgaagttgatattttgctatactataattattttaaaagacagactttttgcctttctgaaagtagttttcacaaaccttttcagtacttctttttgtatctttctcattaattttgaaagagaagaaaggaaatattgaatattctgttgagaaaggaaatattgaatatcgtcttaagacccatgtcttttacctttttaattcctatttcctgatgtggagagaaacttgctcacagtctcctgtactgatggagctgtaaatctaacatacatccagatcatttcaaagcctattttttctcactacacagatgcctatatatttcttcattacagccttttaaatacttttctctgtgataattcccactttaaaatttcgagaaagctattgttctggatggggaaactccctttgtgccctgcagggcctttgggtacactcacccccttcctgcttaaccagaataaagtgctgagtttgcatttcaaatctagaaaataaataccttttctttttctaaaggaactagggcatatggattaaggtaaaggaagatgagaaacaacatccaaaaatacacattttttaaaaaatagtcaactaataagttcatgttttataaaaatataagtaataaattatttttaacatgaacgtaattgtgatttcaaaatttcaaaattatagcaatgtccttaaaatagtgttgaatttaaaatcttcactttacaaaatgtctgtgaccatattatctattatgctgttagtaactagagatttttaagtaaagatagcttttttgggtagtaatattttcatcaaaattgcagtgcagtaagaaaaaaaattcagtctctaccttgaaagtttagggttggaacataatcttagtgagtatatctataaaactgttagcctcaattatctctgaattgattttgtttgttcaaagacacaactgtgaagaatcattattctttctactgtgttttcagatgaaccctgacagatctttcatgacagataatactaaaaattacatgttcatctgtgggaaccagaaggaaggtcatatcttgcttctacctcctagaatagctccatggtatttcaggccatcgaagaggatttttatgctggagaggcagcaaatatgtattgatccttaaataacaatctaatttcttctttcttcctattactttagtaggtataaaatccagtagtgaggtatgccgaaaatggggtggtctttagactcctggttagtactttgaacattttcattttaaataatgattctcttgcaaactggtcattcctgtgatacatatttccctttcacagcttctgaatataacttggagtgatactggtacaatgctgcctttctctcccaccttccaaatgtatttgcatatgtgcagactattcctccttctaactgctacttctctgttttttgcttcttcggcctttcaccttctcacacccccatttcctaactccccaaggccatcattctcaccctgcattttgtagctagcagatatgtccatgtgcatatcatcctttcacttacgggactgtggcatggagaagtgagttgcagtaactagacctctgcattcctgagtggaatgttacagggcctctgcaggagttgatgggagtgggccccagtgagctggaaggttgtagtttgacagtcgagttctcttctcctccttgcatgtagcccttagtttgtgcatcatccatagcattccttattcctcattacttccctccttgtctctctctattgccctgtgtcaagttaggaatcacattcatagaactaaattactatcatgcacattaacattactggcattaaccaaatggtttttataaaggatttatggccttagactaggatttctcaactcagacactgttgacatttgggaccagataatttgttgtggggcactgtcctgtgtattgtaggatgtttagcggcatccctgctctctaccattcaaatgccagtagcacacttcccctaaaacattttgcaaaaactaaaaatgtctctagacattaccaaacgtcccctggaagccacaatcacctccaaatgagtaccactactctaaacaaccaatctattcttttcatcatttttttctgcacattttatgaaatgtatcttgtttttaaattacagaaccgttacctcctttgactttaggatgctggttttaacacaactgggtcattaaattgcttctgacttgtttcatattatggtctcttcaagagctgctacatttttacagtattgtttttgtgtgagatattgaaaagacaatgttagtggtatgtatcaggtgcctatgacaattaattgcctgatcactctaactattctttggagactgtcttggtgattactctgccctcttccttatgtgctttgtgactcgaaccaaactactagtttcaactttttgtaaaaactagaccccacattgttgttatgttttgtttctccagcccaaagcatagcacaataatcgtcttgatttaaggtgaccagttatctccacctgcctaggactgtcctgggtttagcactgaaagttctacatctcagtaaatccttcagtcccaagcaatccaggacagttgaataccctaactgataatttccttttatttctttggcaatcaaagtaatgaatcctactctcattcctgtacaatggcctggggagtttagtacaggggcactgaggtcctgtgggttgagtttggcccacaatcgtggtatgtatgttcttacagtatgcttcccatggaccatgcagccccacattgttttatatctagctcctctacacatgtatgttaatagttttgtgcctgataacctttgctttgcaacccttcatttaaggaccacttccagttttatttggtgaagaaaatctttagctctctgtagatttttcacaagacagactcatagatgtacttgttgttcaagatgtttttctgctaccacataacaagaaatcagctttctgaagcaattaataatctcttggcagtctttctaaaggttttcttgttcccaggtgattaactcaaagacttcttaaagtctcaggactttatagatgaaacagatagcaatctgttggatgatgactaaggattgttaaattatcttctccatacttacatcttctccataatgatatggaaatattccaactttagcttaactccttcaaattaaagtttgtctctacaaaacctccagttaaagtgaaaatctgtgggaaataacaaacccatcagcatatagtaagtttatggatcaaatggttattacacaaccctaggtgaaatgtgataagctttgagaggagatggaaggaagcattctgaagcttaatttgtctggcacaaggtgaggactgaaaggtgacagttctaagcagttaaaatactgtggagataaggagtgccaggagaggggttggaaacaggatattggttagaggaagagatagaaatgaatctgccccataatttgtctggcccttttattcttagcctattgttttaaggagttgcttaatactcgggtcttgaggctactgcatgtaacatgaagaagaaagggaaggagggagagagggagggaggaagaaaggaagggagggaaggagggtggtgatgttgctcattacccactcccagtatatggaagtggctggatcaagatctcattaactttaaaatatcgaatactaatcccgtgatgtcctcccctgattttagtgtagcaggattaatagttgtacttagaaggcaccaatgatcctgttgctgacataatccatattttttgagcagcatcaagagcttgcagcaacctatcgttctggaggctggctattggcactattttataggaaattgctcaaaggaactctgatcatattctcactagtattacctaatagtcgggaacctttattttccttctgaagatggttcaaaaaattatatagatcacccactcctggttggtctttggcttcagcttctcagactcttcctctcctggccaactaccaactgctagaggttgtcagctcactagtgggctcacttattttctgtctctatagcagtatttaacaaagtactgggatgagacatgcctggagagtttaataaaaatgcagattcaaagcctccaccccaaacatactgaatcagaatctcctcaggaattgtatactaaaattatagaaatattactccatactctctcgataaatgatctcatcattagccatagcgttaagctttaaccatttttgtatacttcgtgactcacaaacttttatctccaccgtaaaccactcttttaagctctggtcttatatactctgttgctccttgatagctcttcttggatgtctcacaggtatctcaaatttaacatgtccagatgacaagtttaacatccgcttgaaaaccattcttcccagtttcccatatcttaataattggggccatcattcacagagtttctcaagcattattctttccttgctataagtgtattcagcttaccagcaagacttttgtgtgccagcaaattcttttaattctacctttaaatgatgccatgagttcatctccttttttccgaatccatctactaccttttgccaaatgtaccacgtcttatgtgacaactgaaatagtcttttaactgatctgcctgcttcacctcttctctcaaccagtttgctctctagttaggagccagtgtcatcttttaaagatgtcatgcgtgtcctctattgatacccttttacagctttccactgctcttcaagatcaattccacatcataatatggctgttaagactgtatcaccagctccggtccatatcaccaatctaccacccacaccacacggaccttgccttcattccctgaagctgtcgtgccttggaacctttgtgggtgccgtggtctctgcctggcatgctcttttcactgatccttggctgtttgtatcagaggttccttctctcacttcaaggatcaggttaaatgtcgccttttatggagggcttcatcactctatttcactctatttaatcctcccatctctccaacagactgtattctctcagttcattttcctgttctctatagtactcagcatgttgtggttcttgacttattcatctctgttttctcatggatgatacactccatgagggcaaaaaccatggctgttttcatcactgctgtgcactcattttctgctgcagtgcctgatgaatgataagcactgaatgcatatttgttattacttattaaagttttatttgtttgtctttaatacaaggccaagaatgtcttcagtgtagggccaagaagtgtttatatgggaaacaatttgggtgagattttataataaaaaataacaaatttgatagcgaaagtgtaaacctaaaaactaaaacctaacatggagttgtaatagttcaactctaccttgtccctcctctctcatgctgttatgcagattatatgtcaatctttgataacatttactagccaatgcttcctttagctgtataattcacaatagcatttttgtaccacagtttttttaagtcaggattctagacacagtaactaattttttttcttttatgtggaaaaagaacacagggttgatctcagatacacagataaagtaggcatttccctacagagtctaactctagggagattataaaagcaaataaaatgaaaagtattctttaattcctgtttttgttgtgtgtcccaaatttcaccattttgaatattgtcctgttctgttaaaatcatatatgcttgaaaatgtcattacagtatcaaactacaatgtgtatgagatctgtcatgtcacatttatgttgactagtggaacagagtagcattaaataatgttttccctctagaaggaagagtgagctaaagtgaaaactgactaccatataactctgtgatagcataatttcatttttaagcagaaatatttatgtagatttctgcctcattactgcactgtgagttcttaaagagaaaaagtttttttttgtttttgcatttgcatcattaggacataaaatcataggtgttcataaaattgtattaaaaattggtaactaaaatataaaatagcaatatcttctggctggcaaaagtgcttaaaaacaaaataatacattcttggcaaaagttggaatgatacattcaaacatataaatgtgcttgtggactttgcaggaaaaaatgactaatgggccttcatactttacaaatggataatgtatttgatgttggatatcatatatcatttggtgtttttatcattgtactgcagatttgcttagtcaactttatattagttgcctttgttttctcctttcttatctagccattttcaccttctatgcttggcttattcaggttcagtggtacaaatattgagtaacaactgttgatgttggcatacttttcacaacccctctgtggcctttctcctcattaccttatctgacactcctttcactgtatttttactattcctgcaaaacagactctagtgaaatataggagccatagtgtaatcctctgtctactatttttctcatagtagaaactgtggctacatctgggatatcattagcaagctaaatgctgactatcaaatcttggattgtggccttctatgagtcatttgtctgttgaataaggtgtgtacaatgttggaaagaaatcatagcaaggtctacactggagtgccaacaagtttttcaaaaagagttaccacacccaaacaagcattttttcaagagctaacattaagagtaattaacatttaatatacccccacttgtttgtccattaagtattcttgaaaactaacattttagccatgtgcgtcagtgctcagtttagccccttgatcttttaagtgtttgtctttattaggtttgtcttctctgaaaagagacctttttaaatattaattgcttttcatacaaagtgaacctactctgtggaggttgatggtttagttgaattaacatcagcattgtggtctcttaacaggcctctcctcattatagagaagacttattcagggaatgaggaagagctcagggctcttccttgtacagaccattgttttcactactagaatatccccttaagtatatattcttaaacagggtattaatacatttttgttgatagtctgttacagtaagagggaaacttctggtgaatctttcatctacaacaatataaaaactatgcaattttattttttcctcattttttcaccttttttggtcagataaaaatagccagatttttaaattattatataattttccatgaaatttttttgtgcataatttgttatcaatactcttccatgtacttgagaataccatatttaatgtatatcaagttaaatgatgttgtgataccatttgttaatgtttcatatgaggataattgtcctaagtcaaacagataagccctatcaaaagtgtgtactgacacatttgataggaagcctgtggagaaagagagggctgatggagactgagtttctttcttgcacataaatagttattctcttacttgagagactttgcacacttgttctatacagctgcaaaacctttgcccattccagctgctcactcctaaacccagtctggttgatcagtcttgcagctcattatattgatacactattttaggtgtgatcaatccttaaccccaaggagggaaaaaaggaatccctttctttgtttgattccatatttttaaatatagtctaagattgctttagctattttagctattgaaaataaatcataagggtgactttagttattacacagtgtgaatctttttgcaactcaccttttcataccatgttaggtttctgaaatgtacactagctgtgtgtaggtctgttttatgcatttgaaaggctattctgccctgtataaaggtcctattgtgtgttcattccttcctgtctggatgaactctgaatggtttccacccttttgctcttacacatggtgtttcagtgagcaatacagcacagcggttaacaacattgactccagagctggattgcttgggtttgtagttctaccactgctagttacaggaccttgacaagtcataaaacccagtgctcagttcacccacctgttaaatgaagcatatttcctatgaggtaggcatattatgaagatagcagagtaaaaacacatgaaagacttaaacagtacctgtcacataagaaacactatacaagtgttccatttattaacatgacccttttacacgcctccttacatataaatgtgacacattttcatgtgtaaatgtctagaagggtaatttctgggccacagcataaggatatattcagtttggcccccaaattgttaaattgttctctaaagacattgtaacaacttatatttctatcagtgccatgtaaattactgtttatcctcatcttcttcaacacttcgtgtcatcagatttttttactattttttatctgctgattttaattagcattccctgataaagagtaaagttgaaaatctttttaaattggcatttcttggagttttcaattaatatactttgtacaaaacaaaatgtatgacagtggatatgagcatatgaaattaaaaggaaattcactttttacctctaggaagaaggagcaggaatggaatgggagagcgggtttatatgcatctgtaacattttttttctttaaacaaaaaagtttgaaaaaatatggaaaatttttattgttttaatttggatgatgagtagctgtttatattttatattataatatatattatttatatatattatataaaagccagcatttagacttccttttgattagacatacttttgtatttctcactctttgtgtgtgtgttggagttagcaatagatgtgtgtattggggtaatgatgttataggggtgttagacaacacaaactgaaaggtaatatcgaaatagcttttaagaaaatatcaccttcctatagatgactgataagtgatagctatattctaaatataattaagaaaattagtatgtgcagggaagcaaattacttacggtaaaactttaattataaaagtataaatgggaaaatgaaaataatatctaacatgaaaaatatatttggagcataataggagcaaaaaggagaaactttttcaggtactgataatcatctcatcaattatggtgtgatgataaaacaataaaatatcctatagaatatcatatttaaaatgttttactacaaaattaattagatcaataaaattttacttggctatagcataaaaagttcctttcttttcacttttagaagaatttctgttttagataatatcattaaaataggtgaaatgttattgacaatgaagggaagcaaatgtcataaacccgcctgctatcattgcttatccatgtaaatatgtaatatttaatttggggaagcagtaatatatttgtaattattaatgtagttaatatggaaactttggttctaacatggacaaattatatatggtataacctcatctaggtaatttttctttagtctctattgaaaagttatgagttcagagtagaaaatgcactttaagtttcatcctttagaatgtaaagactaaaggatggattcttttgaaaaaattgactagaactcttgattctagtttcaaggggaagtgtcatagaatctttcatggaactaaaaaatcattagtgtagatttatccacttcttttgctttgaagtgctcacctctctcaatgttgcaaaatttcatgtgaatgtgaggtcacctttccatcatatttcttaacatgtttcatataataaacttttattatcttgagaaattttcaaatttgttctgttctagtactttctgattcaaattgtccaacacagtgttataataatttatgagactgtttcattgatatgaagatagaataatatgtgataaaagtatggttttcttaatttcccagatcccaaagaacaaagtcttatgtcattcaggcctggcaatttgaaaatcataaccatttgaaaattaggtcagttatggatccattaatcaaatacatttaaaaaaactttagtgaagtaaattggaaaaacaaagatactcatttaaagtgtacaatttgataagttttgacatatatgtatatatacataccattaaaaatcatcagcacaatcaaggtaatgaggataccccaaaagttttctcttaccccttttaatccttcacccccactcttctatctccagttagccagtggtctgttttctgttacaaaatatgagtttgtatattcttgaattatatatttttgttaatgaagcatattcattataccgcaaaagagaattccaatccagtttgtaatagagtgatatactaattctaaatgatttttctatattcattcatgtccttgggaagtgtccaaaacacagcttatttctatccataatctttaatcaaaacttacccaattgactttggctctggccaagatggagtaacaggggtagatgagttgcaagcagatttgtctattagttatctattgctgtatgacaaattataccaaaacttggcagcttaaacaacaatcatttattatgtcacaaaatttctgacggttgggtatctaagagtggctttgctagggagttttggcttctgctgttcatgaggttgctctcactatcagtgaggaatgaagttaaatgcttgactgagggtagatagtctgtttccaagatgactgactagtgtgacgattggctagaggctccagttccttgctttaggaaggctttggattctcaccttttgggctttttataagactgttaatgatagtatcagcttcccccaaattgaatactatgaaagagagaatgagcatgaccaaggtaaaagccacattttatttgacagtctactcttagaagtcatgtgccatctcttctcccatattttactggtcgcacacaactaccctagtctactgtgggaggggactacgcaagagtatatcaggaggtggggatcactggggccgttgtgaaggctggctgccgtgatatgtttggctatataaagtcaaactattcgacaagttttaagactcttgtgtaatcagcccataaaatctattttagcagtatccatttgcttataatttatgagctgactacacaatagttttacagttttatcgaataataacttttaaagcatgtatgtatttaataattttggaacaaaagagaaccatctttataggttaaaccttcagtgtgttgtaaaagaatctgaatcttatttactcataaggattacttgtaaggactaataataaacattaaagattagctaattcaatatttattttttccatgccctgcagtgacaaaaggttgttcattttggagattattaatatgttgttcacactgttcaatgtatttccaatattttaggtgtaaatgtatcttaacaattaatgttgctttaaaaactggtattgggaaacataaagaggatatcattaaatctcacattagcatactttcagaaggtcatctaaagctgaattatagcttgtggctaaaccctaataaagactcaaaatattaatggatgttctcatatattaatggtaagagagtatgtgactcaaaataagcccccaaatgcaaacaataaaaactaaattgaacacagcatcaaaaaatctgtcagtaaaatcattgtgccccaccctatggcacatgctattcccaaggcagagcagcaagctccaaagcttaagttttggcaaaggttttcatcattctcaaacctttttccagctccaagatctgtgttcattttcattattatttttatgcccatatcccactgcctcattctctgctgttacttatcactttatgacattaggattacctgcagaattggatgtaattttaactgcacccaaaaccagagcagcatataaaatgagtaggtgaaatagcttgcctttgcttagtgagttgtggggatggccggctgtggggtgggaaggactgtgtatgtctgctagctgacaaaactgagcagattaacaaattttgactattctgctcccatgacaacactttatttagcgatatttcagtaccttgttaaaaccacagcagtcaccgactctgcaaggcagcacagtgacttcccagactccagtgagttccctgagtttgacagacacagattcactcaagcacgaacacaagaaatcgcagagtgcaagacaatgggtatctatttctaagaatgaatatggaacctgtttcatttttcaccttcaacttcttcaaggtgatttttgattaaatgaggaatgtccatattaagaagcaatgtcttgtttcctaagtctggtccttaagtcaaagtgctctaattagatcaattttagccattcattacattaatcagtatttattaagtttctcttttctttcttttttgtttttttcagacagggtcttgctctgtcacctaggccagagtgcagtggcatgatcacggctcattgtagcctcgactttctgagctcaagcagtcctcccacctcagcctactgagcagctgtgaccacaagcatgcaccaccatgtctggctaattttttttattttttatttttgtagagatgaggtcttgctgtaatgcccaggttggtcttctgggctcaagtgatcctcatgccttactgagtttctaatatgggccaggtaaccatgttcacagtggtaaacaaaaaaggacacagtctctgctctctgaaagtaaataccttggcatttgagacagaatgaaggggtacataaacacactttagctagtggtaagtgtaacagtgaaaatcagagagtaattgaagggatgtggggtcagaaaaagcatcactgtggggctgacatgtgaattgagaagaaaggaaaatatctaagacaataacagtcttgacagagaaaacaacaggtgcaaaggcccagaggcctgaaaaagcttggcatgcttgagcaacaaagtggacattgtagctggaattttaacaagatggggagtcttagaaaatggtgtcaagaggtgggtagggtcttcacatagcacatctttaaaacttcacctttcttttctctttttctcagttaaataactacatagaatatctgtcgccttttcagcaaatttcaagatagaacactgaggagaatgccattattttggctacttaagagttgaaatagcttctaatttgctggtaatagttttaacttgctgtcctccagtttgggagatacagtgtaacagggagcatacagccaaaatctgagacatctgtaagcaagcagtcaggagtagcttgactatacatccaaaagtatagtcttcataactttgctttgtgaactgcttctgttaattttttatgaacagttggcctgaaagttgtttatttataaatgtgtcatttattagaataagatgtgctctattctgtttaggagggccaatgggggtgcagataagtgcttgaattccattctcggaggtcattgactatcaaaatgatcaagctaactggatttcactgtagttgaaaatataaattgttggattgtgtcattgttaaactgtgataaattaatttaaatgcaatagatctgaagtttcttcctcagaaatttcagtttaaggaaatttatctctttatgtttgttggtcttacaaatttattctgaaataatcagattttaaaataaataaatctgatattacggtgaccagtggtttttttttttttttttttttgagacagagtcttgctctgtctctggggctggagtgcagtggcgtgattgcagcttactgtggcctcaacctcccggctcgagagactcctcccacctcagcctcccaagtaggtgggactacaggcattttccaccatgcccagctaatttatttttgtattatttgtagagatagggttttgccatgttgcccaggctggtctcgaaatcctgggctcaagggattgacccccctcagcctcccaaagtgctggaactataggtgtgagccactgcacctggctgatttgttatgtattatgtaagaattgaagttatttcttgagaaataaatagataacaatttgcactttaataggtaatgtatcaggcaagttgacacccattcatctggtttggcccctgacagctatgctttattatatggtttaaatagatttgcattagaagtgaaactactgtaagaaaataaatatctcatgtaaatgaaaaagtaaatactatgatctctcatgaaaaagactataaaaatgtagccttatcatgaactccttgtgcctgcaccagcacaagacagcattaattgggcaagaaggggcctatcaggctggatgacattccccttatggcaggttcttgttggggggctgacccacagagtgtagaccatgaagtcccacaaagcaatgacctgtatggacaggttaggaaatttgaatccttgctttagggagtgaagtgattctttcacatgtatttgcttctgaaatagctatttcttattggctccttattgtttgttgtttgcacacattttaaagaggaaaatgtctcaccttagagaaacagaattgaatacaaaacatcactgagctagcacaaagtttagcacattgaatatatacttacatataaatataaatattatgtaaagttttagttttatagatttagttcaaataaaaataaactgttgacagaaaggcaggataatgattcatagttaatatttaaatgattcaacattgaattcaacaggtctagattttttacccttacctgctgcttgttaattttgtccttgtttcaccagctataaaatttgaataatatagtgttaattatttagaagagtaatgtgtggatgtagatatatgtgtgtaatacacatatattgtagaattaaatttattatataaggggtccttgaagtactgcaagcattagcacagtgcttagcactcaacaaatacgaatatcattgataatcatattttctcctttttgtgcccccaaggtactctttggacaaagtactcttggacattttgtattctactattgtaatatcattcaggactaaatcaactctaaaataagtttttacatctatttggaaacctagatcttcctttttgagggctatcgttttgcctaggaggccttctttggcttgggttagctatgattaagagggcaagaaaatgtttcccttctgccgtgcctttagagtatgtgtgggtgggaacaatgtgctcatgtaacctaacagcataggagagggaattgcagatttggtgaacttgccaaaccccataacagtagcagatggatgaggtttagagggtgttgtgccctgtcaccagaccctgctgactttagcctggcttttccaaatttcagagtctttgcctttatccagttccctccaggcccaggaggatcttaaaagtaagatagaggttttctaatgaacaagattgcttgatgtgtcccctaagaagcactcttcttttggctaggcatgtgtagtattactttggaaagtgtttgtttcattcccatggcacatttatatgtattaatccctgaaggcactatgaagtgtaatatgaattgcaagttcattttcttctgtcatgtttgactatttggtgctgatgatcttttgcaaagagaaaataatggataacactttctgttcagaaccagaacatgagtctcgaatgaccttaatttttatgcttgggccaaaaagtagaggatcctggcaatttcagtcaccattgtttggtcttcagtgctcataccatttccttaggtggttatcatattttagtttagctcctacattttaaatagatagtagagattcatttttaatgcttgataagcagccaagtttcaggcttaattcacttagtcagtcttgagtcattgctctatcctcactttcatagcaaatatcatcattgggattacaccacaatgttttccttctgaatgaacagtttcacagcttaatataggttagtattttcaacatgcttgattttcaagcatgcttgaataagtttacatgctagaaactggctgggtgcggggactcacacctgtaatcccagcaatttgggaggccaaggagggaggatcacttgatgccagcagtttgagaccaagcctatgaaacatagtgagaccctgtctctacaaaagatttaaaaaattagccaggtgtggtggtgcacacctgtaatcccatctattcaggaggctgaagccggaggatctcgtgtgttcaggggctcgaggctgcagtgagccatgatcacaccactacactccagcctgggaaatagagtgagaccctgtctctaaaaaaataaaataaaataaaataaatgctagaaactggttgaaagtaactgaacaggaggaactgaggatgtggcactcattcttggaaatcagttctggttaaagattaaaacagactctgctgctgtctttcttatgtaaatataaagtccaagggccacacatgacatagaaaaaatatcacttagcttctgtaaaactttttaaaaattccttctttaaatgtttcatgattatacattgtttgcaaagtaaatgaaacaggttaacttcctggatgcttacttttagcagaaatatatcagatagcaaacttgctgacagatgaatcacagctttgcccacctgtaatgaggatacactgctggatcccaggttggtcccagactttcagggtggtatttctggcctccagtccacttagggaactgatcattctgcatacctctctgggattatgttctccacctcatctggcccttgataggtaaacatcccctacctggccaaaagtaacaaagctgaaaaaacttggccaaatctgggaacttgttagtctgcctcttcctgtaccagaaccgcgttccagattgtttcccagggtctgacttcaggccactgttctttgctggccttgacctcagtacttgtcttataaatgactttatgcttttctccctctgcctcatcccaccctcgttctttgtatcctacctctaatttttatccttcagacactttttatttttctcccttgtttgaatatatttttagttttctctaggccttgcttaccaacctatcataccttccagactctcatgctccattccttccactctttccacctcaatctgttctacctcacctgaagactctgataacgagagcaaggtcttccacctgagcctgatggggttttggccagctgacattcctccatcacctaatggtcttagctgccttgtgtcctgtccacctgagatgacaccccttgcatccagttctttgagagaaataattcttattatagatttgtcttaaccgatccgtcaggtttcctttctctgactcatttagtcattactttttctcagcgaatttcatgttggatatacaaactaacaaagcagaacatacttatttcatttacaattttggtaaagttttattatgacacctcattttaggtgtcactcccattatcttgtttaatctgttaacatgcaataaagacaataataaatagaagggaataaattttatgagcagaaagtagtatttgagaattttctgtccatccatttagatagagatttaatagttctcttaaaggcattatttgtatgcccaaacttctgcttatagaccattgccattctttttttttttttttttaaatctagatctgtgcttctggtgtgtaaccatgaatataggtttgtatatcaaaacaaataaatatctacttgtacttgtatgagcaaaatcacccttgaaaatcctttacactttgcttgatacctcagagtttgttttgttttgctttttcatttgcttaggtttttaaaatttaaataaattgccacaatttaaaaatcagaaagtttcaacaaaaacagatttcaagtgcaaaaaaaaatttcgagatctctcaacaatgctacctgcatttctttgccgcaactatatgcttgtgctaaggagcatctgcctcttgacatgggaatgtgcttgctgctttgacacaattcatcactcacctacattacttgcctgggctttatagacatatgagtttgtgcttcttgtcttaaaggagaagcatagttggaatcaaagaggtaaaggcatagacttccacccagcaatgcttttcttttaaaagaaaataaaatatgtcccctaccccaaaatacaaagaataaaataacagtctttcatagtaccactacctagaataaatcattattaatattttggcatatttgttttcagattttttcccctgactaatcccatttttgtcctgtagaattttatttctatatgcaggggtgaatttcttctcaagaagtctccctcattcttaaaaatttactacctttttcctcaagagatataataatcttggttttgtaaagtccattagttttgtgcctaaggcattagactttcctcagatcagagactctcatggttcctagtcagaccattaggcccaagtcaaaaacatggttatcagttaatttcatagggatttaaataggataaagacacagctctaaattctttagtaggttagtttgtaagtgttcataaatgtggagcatttcaagccagattcatcttagtcctgaccttacttggttagagagttgtcaggccaacttcaagccaatggaagtgagatatgagtataatcaagtaagcatccagaccaaagttgagaaattcagctgcccttcatgtgtggtatcatatccacagtcccaagtcacctctattgcccctaaacctttgtacccaagagctctcccattaagaatgaatgtgaatccatttgacttttgctccagctacttacataatgatcaacctctgatttgtaattcctgtgcatgttagcaattctatctcaggtgtttaggatgcaaataattttttaaaaattagtacttggcctcctttgcttgctcccaaaggagaatttaatacatagtatgactgtgacatatgtatttattaaagtataaaatattttttcagttaggtgaaatatagaactcaacagtttggtatatagttggtgttcaactgacgtcaacttcttcctttttaaaaatatgtactattctagcaatatcatggattaaatgggattctgatagcttcagtttgtgttttattctaagtgttctaagtgtgataggtcattgtaaagttttggttcctgggtagagggtagactgtagtgtgaatagtggcctcttgggatagtggaagcagagaggacagtttagaggcctttgcagaagtccaggtgaaagatggtgctgattttaactaggagattagtagtggggagacgaggtttcaaggttgccctgtattttgaaggtaaagctaacaggacttactgctagattggatgttatgtgtaaggaaaagaaaggagtcaaggaagatccctgggttgaatcattcaagctttattgatttctttcccttaagacaccaattatccacgttatttctacctttaagaaatcacctttgaaccattttctgttattaagtggcttctcattcctccttttctgtcaccacctacctgtggaaggttacagattatacctgttttgtgaactttctaacagattttgaaatccctgttctttcatcaaactctcctgattaaggaaccaaagaccagactatttccacatagtttgttcagttggaaggaagggtttccattagctattccgttctcaaccaagttacatatgttgcctccttgctgtggtgcacttatcttttatttggacaatacctgtttccattcatatatttgctctgcaagtcttaattccgtgtttcaatatatgcgcatcaatataagtgcccatctttgattgttagcacctagagggcaattgttgtcttacttgtgcaattaggttctaaataaatcatttttaagcgatgataacattttgattccaacgtagtggctgtatttgataagaactttaatcacattttctccagtaattaggctctttttggctgacatttaaagtgatggaatggtatctttagaacatctggatttttcagaaggcagcttctgcttttagttttcaagtgttggcctctttaccacgctgagttcacaagttctccatttatgacggcatcatgcctttgccattctgccacatgcatcacataattcttgttactggaaagccacttttgtgtttgaaactatttcgaaagggatggaaaaatcccttattttaagaaaaattgacatcttatggtagtaatctaaaattttcattgagttggcttcaatactatgtttttatgaaccatgtgtagcaaaaggaattaattttctttgagtatcaccacacagacttttaggaaccaagaatgatttatttacttagtgtctaagatttaccaacttaagaatggaaaaatcctattggatcataagagactgttcccttccctactgcaggattatgtgctacagtgtatttcctaatctttgttctttttaataacattcttccggtattcatttgaaagtcattactccaaaatatttccatgaaattataatatcatgcctggttttagatggagataaatttctgatgtttgttttataatatccaccaaagtttattttttaaaaatattaagcaatatttatctctttaaaatgggacaattatactagtcccctaccagtttaaataatagcaatattttcttttactttactaactttattatttttggattagtgatattttgcttggaacatactatggactgcagattatttctcagatatactttagaaagaaattagcatggacctcaagccaacaggcaagcagatcagggtttgttttcttttaaaattttttttatttttaatttttgtgggtacctagtaggtgtatgtatttacacagtacgtgacatgttttcatacaggcatgcaatgtataataatcacatcatggaaaatggggtattcattccctcaagcgtttatccttcatgttacaaataatgcaattatatttttttagttattttaaagtatacaattaaattattattgactatagtcaccctgttgtgctgtcaaatactaggtcttattcattctatttttttgtacccattaaccatcctttcctttctgtccaacccccaactacccttctcagcctctggtaaccatccttctactctctatgtccatgagttcaattgttttgatttttagatcccacaaatagggagaacatgtgatctttgtctttctgtacctggcttatttcacttaacatagtgatctccagttctattttgttgcagatgataggatctcattctttttatagctgaatagtactccattgtgtatgtgtaccacattttctttatccattcatctattgatgtacacttaggttacttccaaatcttggctattgtgagtagtgctgcaacaaccatgggaatgcagatatctcttcagtatcctgatttcctttcttttgggtatatacccagcagggggattgctggatcatttggtagctctatttttagttttttgaggaacctccaaactgttctctgtagtggttgtactaatttacattcccagcaacaatgtctgagggtttccttttctccacatcatcatcagcatttgttattgcttgtctttcggatataagccagtttaactggggtgagctgatatctcactgtagttttgatttgcatttctctggtgatcagtgatattgagcaccttttcatatgcctgttcaccattcgtttgtcttctttgagatatgcctattcagattttttgccaatatttttttttctagagagttgtgtgagctccttatatgttctggttattaatcccttgtcagatgggcaattttcttccattctgtaggatctctcttcactttgttgattgtttcccttgctgtgcagaagctttttaatttgatgtgatcctgtttgtccgtttttgctttggttgaatatgcttgtagggtattactctagaaaattttgcctagaccaatgtcctggagagtttccccaatgttatcttgtcagaacttcatagtttgaggtcttaggtttaagtctttaatccattttgatttgattttttttatatggtaggagataggagtctagtttcactctttggcatatggatatccagttttctcagcaccatttattaaaaagactgcattttttctcagtgtatgttcttggcccctttgttgaaaacaagctcactgtaggtgtgtggatttgtttctggcctctctattctgttccattggtctatgtgtctcagtttacactgtaccatactgttttgattactacaactgtgtggtataatttcaaatcaggtaatgtaattcccctagttttgttctttttgcttaagacagctttgactaatctgggtcttttctggctccatataaagtttaggatttttttccatttctgtgaagaatgtcattggtattttcgtaggaattgcattcagtttttagattgctttgggtagtatggacattttagtaatgttgattcttccaatccatgaacatggaatatctctcatttttggtacccccttccattttttcatcactattttatagtttttattataaagttctctcacttctttggttaaattaattcctaagtatttaattttatttgtggctactgtaaatgggattacttttgtgtttctttttcaaacttgtaactgttggcataaacaaatgctactgatttttgtatgatgattttgtacccttcaacttcactgaatttgtttatcagttctaagattttattatggagtctctaggtttttccaaatataagatcacataatttgcaaacaaggataatttgacttctttttttccagtttggatgccctttatatctttcccttgtctgattgctctagctgggactttgagtactatgttgaataatggtagtgaaagtaggcttttttgttgtgttccagatctcagaggaaaggcttttggtttttccccattcaatatggtgctagctgtgggcctgctatatgtggctttattgcattgagatgttttaattctacatccagttttttgagagtttttattatgaaggaatgttgatttttatcaagtgatttttcagcatcgattaaaatgatcatttggttttagtcctccattcttctcttgatatatcacattgattgatttacctatattgaaccattcttgcatccccaagataaatcccacttgaccatgatgaataatgtttttaatgtattgttgcattcagtttgctagtatcttattgagggttttttcattaatatttgttgaagatattggcctgcatatatgttttttgacatgtttttgtctggttttggtatcagggtaatattggcctgatagaatgagtttggaagtattccctcttcctctgttttttcagaacaatttgggtaggattggtattagttcttctttaaatggttggtagaattcagtgaagccatcaggtcctgggctgttttttactgggagaaattttattacagctttgatctcattacttgttattggtcagttcaggttttggacttcttcttggttcagtcttggtaggttgtatgtgtctaggaatttgtccatttcttctagattttccaatttattggcatatagtttctcatagtagtctctaaagatcctttgcatttcagtggtatcagttatcagttgtaatgtctccattttcaactctgattttatatatttggatcttctctcttttttcttagttagtctggctgaaggtctgtcaattatgtttaacttttcgaataccaactctttgtttcactgatgttttgtattattttcttcatttcaattgtatttattgctgctctcttctttattatttcttctactaattttggatttggtttgctctgcttttctagttctttaaggtgcatcattaggttgtttatttgaatttttttgctttccattgttttaatgtaggaaaaggcagaattgctagactcatgatccggacatgaataacttgagtaataatatacataattaatattctgaagcaatttggagatgcacatctaaacctgctaagcctctctgtaggtggcttccgtttacggtccatgatttccagaggatagtacaccagcacttaattgcccatcttttccaagttaagatacatatatgaaatataactcaggaatagtttaaattaatccacatatttgttattatgggcattatgaatacattacatggtggcattgttgacatttctctttttaacctcatggtgtacatattttatattcccaaatatagtttggaaatcaaatgacttataaaaaacaaaatagttaactttggaaacaaaagaatgagccctaatgttatgtatcactttggttggattcacatattgtcctgaagcagtctataattaaataatcatttaaattaataaatattattttttgtccagcaaaccagataaaaatctgctaatttgctacttaaaaattggcagtggctcttcagtgcctcgaaaacaaagtctaacctccctaacatagtgtatgctttagtaccaggccacattttagtcctaccttccatccttccctttctcacaccttcttcctgccccacccctcatatgttagtttgtctcatatctttttccttgtggattccgcaatccaaattttgcccttctgccaactgtgatttctcccatctttacctggtgaattgctattcatccttcatacccaacctcaaatggctgggcatttgaagactttctggacttgattaggtggacctgaaatattttatattctctagggttttctaaggcagagatgaaactttcttcatctctgtattcctttcttcatctagtacctaccacagtatctgctaggtgttcgatggtaggcatattgtaggagcttatggaatttgccaaattattttttgtttttgaaatagagtcttactgtgtcacccaggctggagtgcagtggtgcagtctcggcttactgcaacctccatctcccgggttcaagtaattatcctgcctcagcctcctgagtagctgggactacagaggtgcactgccatgccaggttaagttttctatttttagtagagacgggctttcaccacgtctctctggctggtctcgaactcccgacctcaggtgatctgcccacctccgcctcccaaagtgctgagattaaaggcgtgagccaccgtttcaggccggaatttgccagtaaattaatgttacgataatccatacatggatagattatacttttttatattatttaatttaattttaatttttaatttttgtgggtgcatagtaggtatatatatttatgggttacatgaactatttgacataggcatgcaatgcataataatcacatcggggtaaatggggtatccatcacctcaagcatttatcctttgtgtttcagacaattcaattgtacgcttagttaattttaaatgtataattttttatgatagcctgttatgctagcaaatactagtatatacacattctttctatttctatacccatagattatgatttaatgaccacttgccaatatttcctattctgattcttcatatttcacatatgtgaagaaatctgtgcctattgtattttgatacagactttttgcttgcctttactttgaattcagtggtagaattttattataataacctaagataaattacctaatcttatgtaagtatatactaaatattgtgtatatgaccttctgcgcatttgcctgagtgaagagtgatatattattaaagggactctcggaagcatttaagaagcattgcctattaaaaaacaaagtgtaacatgaatccatagctctccaggtgtttggaatctctttggaggaaactcatacatgaaacaaacaaacaaaaatgtaaacacagttgagttaaaatgctcagaggaataatcactataggaattcagagaacggtgtgttgagattgttaaagagtaagggaggaagtaggattttagagtgattttaaggatgagtaggagaggagtatattgcgggagattgggagcattagagcagaggaacaacctctgaagagagtaagaaatctttcctttccttggtcccttcttatgccatcttttctctggacagtgttctttgcctgctgcgttgttgctcagggtcacattagcttagttctgggaaagcatccagtaggaaacgtgtaagaaacttcctggccatagcagaaaattgctgtagtatcaaattgctttgttgcttgggcctcacatctgtttccttgccctttcaccaacccctgtgctactaaagtggatctcctgattcctgagtccttgatcttttgaccattccaaaatgttgctattatgccttggtgctctctgcctgtttgatttctcctctacctttcttgtctgccctcctgtgacctatatgttgtaacgtttgcctggctgaagtctgaagactcagactcttggctggttagtatagctggcttactgtccagctgacccactccataggtgatattcccaaccagacaaattggagtcctggtctcttgcccagcttcttgttctgtcataacaaccaacttgcttggtatgaagggttcatttgtgggaatactaaaaactttgtgagaatacgcaaaaagaaaaaaaagagagagagagacagagagagagataaagctaggctgtggaaagatttgcaagaaaggttgaagtttatatttcgttctctaggccagtgaccttcaaagctcaagtttgcacctcaaaagtaggcaagatgatccatggggtatggacagaaattattatattataatgactggctcagtgtgtttctatctttaaaaagtttttttctaagaaatacagttatttaaaatacagaagaaacaaaaaaaccaaacatttaaaatataaaataaattaaaaatacaaatgtttaaattgtggattgacccaagtcaccccatgtgtcagttggtcacatatcaactttggtaacaggcttctggaggaaagagtatgaactccgcgtcctggaggcgctgacagcaggaccttactcatttattcactttcagcttgtttgaggtattgctgtttatgcgtgcctagatttgcagattgtgtttttagccttaagcaaaataacatttgtaaagtggtcaagtgcctttaaaagattcctgccaagagcctgcaggttgaagctactacttgtgacgcagtcacatggaggagctgatacttgtgctcctaatactagctttagccacacttagagcaaaaatcagtggtattttaatcagatataaccgaacttctaccaccaaaagttgataatttccaagaagactattagaaaagtgaatgtatccaaatgcctttgacaaagaacctcaccctaagtgtatattccactttgagataatgcacattgtgaatatagtattatgattagccagtcatttaaaaatcgtgtttatttcatttttatactcaacctttaaaatgcccacttttaatggacacttttagtgtctatgtttagttttatatatatatattatctatctatctatctatctatctatctatctatctatctatctatctatacacccgcacacacctgtatgtatttaattttgagaataaacatatatattatagataaatatttatattttgggcacatgatcaaaaagttttcaggggattattctgtggtcatctgattggaaatttttagagaatacaggtactcccagtgaggggtggtttctttaataacaagaaactgaaaactgactgaaaatctaatcttttatgaaaattacttcttagatgctttcagaaatgttgcttcttaccaatgtgatacataaaactaatctcgtttgacagtggtgatgacaagttttttaaatcagttttcctatgtattcctgttacagttttggttgtttatttgaaccttgaaacaccagagcaaaaggaggatgatgttaacctagtatgatatggttattgtattagctaagtagtagctatgtcttatttaatattaaaaaacagcgagtaattcgtgtgttttctgtccgttctacaaataaacctggtaatggagttttttcagagaaccataacatctgaaacacattcgatgggtttaccaaagaaagtaattatggctgtaaaatctgtgtgactatttttaagtgaagttcttcaggaaaagggggtagacagcataatgagaattctatttttaacttaggtcacttttttcatggactgacaatgctgtgactttttcagacagacaatgagccatctagcttttgaactctttcgtattctgtaaacattaggaagcaccagtgtgtctcctaatgtaaacacactgatccagacctcatgaggtatattcatgatcatttactttgtttattcaaaggtcattaaaagatgtgatttagatttgttttcttaatatttctgtggaaactaaaaagctaatctacaatgttgttttacatacaggtttacctgaaaggaaaataaagtttattttagcttttggcaatttttattgatataaaacatataaagtgagtcacacaaaagttgaccttgaaacttctcatttttcatgttagtggttttaatactattgcatttgaaatttttaacttttaataaaattgggttaaattgtatccctccttttctttatatatttattccgcctctgttatcttatctttctgcatctttagaagattataagcttttggaatcagaaacaatgtcatagacttttcttttttttgtcttcccaggaagttgattaaagtagaaactgtcatggtcccacagtttcctccagtagctcaggttgaggacagattatacataggacataaggaaacagctgctaagtctcctgttgagcagcagcataaaagcagcatgtcaggtctgcagtactgggttcaaatcttggctctgctaattctaagctttatggagtgggaaattgactccatgagtcaatctcatggagttgttatgaaacatgtaagtttcctaacaaggtgcttggtaagcggtaagtacttcatgaatatgagctgtttttattatcagtatgattacgtggaaaagagaaccttgttagcaggggtatttaaggagaaagtaacttctcaaaaagaccagtggtgaaagcagaaaggctattgcagtgtggatgccaatgccccttctaaggaagcaagcaggagggaaagggaaaggagaagcagctggacagaagcacctgtgtcagcttaaatgacagtaccaaacatttctcctgaccttctgccagcatcatctttcttaaaaaataatttcaacttttattttagattcagtggttgcatatgcagatttgttagttacagggtatattgcatgatgctgaggtttgggatacaaatgatcttgtcacccaggtagtaagcatagcaccgagtagttagcttttcaacactttctcccctccctccttccacattctagtagtccccactgtctattgttgccatctttatgtccatgagtacctaatgtttagcactcccttacaatgtggtataagtgatattggttctccataccatggagaacgggggttatttggttttctgttcatgtgttaatttgcttaggataatagcctccagcagcatccgtgttcctggaaaggacatgactttgttctttcttatggctgcaaagtatcccatggtgtagaagtaccacattttctctatccagtggactgttgacaggcacgtaggttgattccttgtctttgctattgtaaatagtccagcatcatcttttgctcaaagttaattaagtccacttctcaatcctatattttccacatttatttctctgtagtagaaatttgggactttgatgttggggttcgaaacatatttttattttccttcatgaaatactgcatgagaaacaagactaggcaaacattttaacttgtaagtagtaagtttctcattattaaaatattcaatgtataaatcatgtgccacacttagccaggggttcatttttccactggctaatttggggccccaggaaaactgagcattatagactgtggaaatatagccagggccttctcagtgattagatattactgagggcagggtggaatcagtgctctgcatttatcccattacagctttggagtgaaagtgtcacctcttcccatagcagcaattacactagcaattagagaatcaacacttttatgaatttcacatctggcccaaagtacaagcctgaatttctagactttttactataattatcctgttatatcaatatttatcattttcttagtgggaagtcttatttttataatttggtagaagttatctaaccaattagttctaataaaagtttaacattaaaaagtggtagcataaaaatagttttagatttaatgattcatatacacatcacattataaaatgtcttttgcagtaaagttaaataataaaatgttttaaatgtctgagttttattttttttcttcgttgcaggaaatttacatttgatgaggaaactaaatatcttccatttaaagtcataggcctagtttatcataactcatgcttctcttcccattttagagtggttttctaaatataatcacaaagtatgaagtttctttcataaaaccttattctgaaatgagttccatgtgagtgtttacagggaaaaccaagccaaccaaaaggcactttcaagattcatgtgtttgctttatttaaaaatatctataattagttgctcatagataaatgatacttttgtcctgcctcaacatcataaatctttgcgggtgaatattgtgctataatgttttttcaccatgatatgaattttaaagacttaataagcccctcttagcatggttactttaacagggaaaattgaacccttggtttaacatatgaagtagtgagtggggctttagtaatggatccagatttagctgaataatacagtttgaatatcccttatccaaaatgcttgggaccagaaatattttggatgtggggtttttgcacattttggaatacttgcattgtacttatcagttgaacatccctaatccaggagcccaaaatgctccaatgaacatgtcctttgagcatcatgtaggtgctcaaaaagttttagattattgagcagttcagatttcagattttcaggttagggatactcaacctgtaacactaaccttaattgaagctttaccttattccagacgctgtgctaaatctttcatagagactcgtctcatttaaacctcacaacaaatctttgaatgagatactcttcttgtccctatttttaaaatgatgaaactgagtttaaataaaactgtgaatgtatttaactcttctaagatcacacaactattaagtggagataaaccttaaggctagatgaagagttttaattttatgttgagtaaaacatacctttacagcaaatgtactattaatatgtaagtcaaagttttgtaaatgtgattattttatctaatctttaattaataaaagagatgatttccccatttctgattgatttttacttgccagcagctgctagatcctttccattaagtttataggtcaagttgttaataatctttaaacagcagtttaaacctaccagctaagtttatttattaacaacaacagaaacaaaaacaacctgtttttcaacattccttttctaataagcagttgttataggaccacaatggaatatatgttaattgccttcaagatctcttaaaagacaaattctctaagtaaccactggagcatttatgagcaaagagattttattgtccctgcctacatgctcccctaaaaactggatgagttgtgatgtaactttttttcttctaagaaatttaacagttacagaaaattcaaagaatataccaaatatctccataataaaatattactactgttatattttccttcaattattttgttaagaaatattgcaaacataaacttttaaaaaatgttcagtattattaatttgtgggaattatttattacctagaaaatgctcacttatccagacagcgttctaaaagtaatcatagaaaaggtattccaatgtactttaggataatatattcttaattatcgtttgtatagggcattatttattattttaaaacagcaagtaaagaatttaaaatgatcagtaatctggtttaaaggactctgatgctaaaataattattttgagatttgttgtgtagaatgactggattttgacttaagaattcagtggctgtttaatccccctgactttagtattacttattaatctctgtgtcctttggtcaggaatttggggaagagccacatgaactgagcatgactaggtccacaagcttgtttatttgtttttccgttgtgactgaaggctaaactcttttagaaaggcaaaaggagtctgcaaaaattaacgctgattgtgagattggtggaaagagggtgggaacaaagtaaaaaatacacatcaagttctaaaattagccactgtgatcaatgcatgctaccaagggggtgctgctggctgacctatgatgggaagaccctcccccagcccccgtgggtgctgatcatgctaagttggcacgcttcatcattaaacaaagtactaagattaattacttcaaaggggtagattagttgattttaactgtaaaaatgcacatatttaacagtttagcatttcatgatttatgtgtataaacactgagactctaatggtaaggcgtttggccatacctaacataatttatttgttcatactttcaagcccttgaaagtttttgatccccttatatttaaggtggcaggttttggtttagaagggtatgggcagagaatgttggcctttctgtagcatttctaagaggtttttgagtgtgaactagcaccagggcttagggaattggagagataggaaggaggggatatttggatgcaagatgtcattggcctctcactgagtattcagtctaggggcaacctagccttaattatgtttttatggatttttttttttcaagaatcccatcccagtgagttgtttagaagcaggattatatttaataaggcaatggcaattttttaaaacatggatttaatataataatttttcatttcattttaaatgacaatttaataactgacttaacatttaaatatatgaagatattttttaattggtaacatcattacaatgttttataaatctaaaagaaatttaaattttcaacaaattcaccactaatactgggggacaattctagatcaattgattaggcctcctttttgatgaggcccaggcattgaatttttaggagctctgctggtgatttcatgtgcaccccaggtaaagaagcaatgttttatatagtttcatccacagtgtacatattattcgatattcaatttacatattctatttcacttaattttatagggaatattttccttgtttcttcagcgttcacaaatttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgccctgccacaaatttttaattagaatgtatatttgtgtatctcaatttattaaattattcatataatattgaatatttcattgtaagttagtagaaaacaatggtgcagtatcatttgatttctctgttgaatcatttccagaccatatcgaaaagaatgaacaaaccttgctgtttgtagttgccacattgctttcataagggatgtagcaatcacaatactatcagcaatgagtgcttgtttcaccacaactttcctggaattgggaattatcgattactaaactcattttaaatcttcattgttttcaggactccaaaaatgaaaagaaggggaaaatgccacaaatagctatgtttataaatggagccattggtagttccctggaagtagagagatgtatacagtgatgtgcctacaactagatccaagtaggttattctaatttaagtgactttttaagtcattaccaataaaaactttaaagatataaattacctacaaccatcaagaatggataaaaattaactactacagcttgtgccaaccatgtgctagcagtgggaatactcaaaataagcaaacaaaacttcagtgaatcaaaacaaaatcaacaggtgtaacctgcttcacattcttcaagcttatatcaagctctgaatctgccaaactcctgaggaagtcagtttcctgtataattgagagataagctctattattgagagaaccaacttctttccttaaaagaataaaccagctagagtctcattttgtattgtttattatcccttgactacagaaagcgtgctaccaagcagaaagcaggctttgtcacaaataccaagaaatccagatgcttagagaatctgagtttttattgttctctttctcctcttcctctccctcttcctctgtcatttgtaccatcatcatcttcatcatcatcaccactatcattttttttaaagaagcatttgtaaagtgctcattatgctgggtactttatctgtcttattttatttagtctttattggtagtagctcttaggcagatatatttcactatttcatttttcaaatgagaatgagctgcaaaaggatgaatacctaattcaaggttacacaactagcaagagcagaaactggaatttgactgaggcatattagatcctacgatctgaatagacttgctaaggctgtttggctttcacagttcagatcagtttagagtgctggatcagtccaatctggtggctgtggcaggtgctaaatcttgtaggaagtagtcccaatgtttgggaccagctctggttttagtgaccccacagaaagcctaatttgactttcaggaagcctgcaatggttttatgacggaccacatctactagactaagtgaaagcccagatccggagagaaatgatccaaacatctatttcccagtggccagatctgttttattaagaatcacattattaggtttcaatgttcgggctattttcagcgattttatctcttgcatcttctacatccatgagtcaccaagttcggtgtgagaggtagatagcaaagattagtggaacaattatagaatttgaatgtacatatatctgagcttgaattccagccccattagttagtatttttataactttggatactaagtttcttaatgtctgtgtgcctcagctttcttgtctttacactgtaaataataataagtttccagggttgttatggagattaaatgagatatctatatataaacatgttatgcaatgtcttgcatatgataggctttcttcctcccatgtatatttactccacaatgattatttaaaccattattttatatttccacttcttatgttactacaaccaaggcctccctctctttacctcttagtggaagaaatttacaccagccataggggtctttctcaattcctcctttaattgtgtctgtccttggtttaggaattcacagtgtgcataacccagagacctaatcaatctggccatagaacataaccctgccctaccctgcctgatgcatctcatacattttgagttacatttctctaaaagctttgttttaatttgcctgctaaagatcatcctctggttttctggcaatacataaaacatttcaaattacatgcatcctcagatatcaaatccaaacttctttttctagtttttaatattttccagctgctattagcttccttcctgtcacccagatcaagaaccacagaatcgtaaaggagcatagaactcatgtaattatttccttttagcccaaatctactgttcctatctcatatatacttctcagcagcatctatatattcccaaacaatggatgaaagagaaagccttgcccgatcataaaagcaatgttttctgattactagacagatggtatttagataggattggagacttcaaaatgatgttgataagagaaagtaatattgggaggtgtagttgatacatataaaattctgtttttacaccttctaatttgttcactttatttttctgggtcttatagtgattatgactataactgagataaaaaataacaactggactttgagaaattaaagttgttcctcaaagtgatctcttttcttgctaaaatgtactataattattaaatgtatttgtgattcaggtaagttttagtttaagctttgagtgtcgtttcattaatggaaatacagataattgcttgagaactcattaaatgtatgtactactagaatagaaaggaaaaatattttgggctgggcgtggtggctcacacctgtaatcccagcactttgggaggccgaggtgggcggatcacctgaggtcaggagttcgagaccagcctgaccagtatggagaaaccccatctctactaaaaatgcaaaattagctgggcatggtggcacatggctgtaatcccagctactcgggaggctgaggcaggagaatcgcttggacccaggaggtggaggttgtgatgagccaagatcgtgccattgcactccaacctgggcaacaagagtgaaactccatctcaaaaaaaaaaaaaaaaaaaaagaaaaatattttggaagagtaatatttacataactgtcttagcctgttcaggctgctataacaaattaccatgggctgtgtggcttataaacaaccaacatttatttctcacagctctggagactgggaagttctaaatcaaagtgccaacaggttcagtgtctggtgagggcccacttcctggtttataaacgttttttcactgtgtccttatgtggctgaaagggccagcgagctctcttgggccatttttataagggcaggaatcctattcatgcaagaggaaccctcatgacctaataacttcccaaaggctcctaatgccatcgccttacgggttagagtttcaacatatgaattcggggagacgcaaatattagaacataacaaatactcttttgaaaatggtttactggcttcctaaatttaaaaaaaaatttctcttcagagtctttttacttttcattattttacattcaggtgcccactagaatttatgtacctttaacagatttaagagttatttctaatatactagtgagaaatgattaatattttatagctgattcctataataaactaacccaatcaaaaatattttattagatgaattagagcagttatcatctcattagtatcttttcctctaattactacagaatgtaaaatttatttatttctcctcattataaggcaatttcctagagtgaatagcacaacaaaaatagtgtaatgtttagaatgtaaatgtggaattttacacattccattttttaaaaatctaactcagttcccctgtacttactaaaattcctcttctaaatgtcattaattaactactggctgtcaaattcaattgtcattttctatttctcatcttcctttgttattgttaactgcatcctactttgtaaaactctctttcttttctgcattttaggtttaaattttgttatcaaatcatgtgaactatgtaaaaagtgagcacttctgtacctgcttccattttaataaataaaacactatcaacaaatttcaagttccctatgtgttcctcccagattgtatgttccttcatgcccaaatgaaagtgtaaccattatccaaacttgcatgtttacaatcacatgcattttaaatattcttttgctacatagtatgtacctgtacataatgtgtcatgtcatattttggtatattttaacttttctttaaataatatcacactgtgtgaatgggtgtgttttttagcacctattttttgttttttgtttcatcattcaacattgtttttatgacagtcttccttatttatttatttattgcttttggtttctgggggtcttgtaattgactgccttctcttctagctgcacaacctctccctatgtattccctgccgcatctggcttctataaacctttcatatttttctcagatccaggactgtctaaaaacctactgaatatctccaacaggatatcccacaagtaacataaacttcatccttcaaaatgtgagtttattatcatctccccagagctgcaatttcttttgctttttctttaactcaaataatggcacactatcaaccctgccatctgtgctgttaaatttagtcattgtgaaatccctggtgttctttacccttcatggctacttaaatcactaaatcctctagaggctaaaagtaaaaactaagctgctggaacaagatatattaatgtagtaatgcatatatgtataataagtaagaccaaacccaataaagttgtgtcttgttttttttttttttttttttctacaagagtctgagatgtctgagccccaggtcaatgcagcactacaacatgtcttccatcttcagcatgtgacttccgaggtcatccttccagcctgtgggagagaggacagtgcaagtccggggtcaaaaactgactcataagcagggcctaagttgttcaatcacttctattcacactctactggttgcaaggggtctaagaaaaacagcacctaagtgggtagccaccccctcgccctaactctatcagtattggaggatagactttggtggacagtcccgtatctgtgccacacataggttcataaatgtcttccagggcctttccttctttacctcgtttcactgccacactgtatggtgtcaacatcgcttgcttaaactattccaaatagtcttttgactgattatattttcttcttccaatccatctcctatgttaatgtcagttatctttctaaaatattggtgttttgttgttgcccttcaggaaaattttaagaagtccagtatctctctgtggcctctgaaatttttatgggataaactatatgacatgtgacaggtatatagaatacttacaacgtggccttaggttgtttctctggcttttcactcattccctatattctatactttgaacacatttgccggctcactgtcacttactatgtcgtgtattttcatagctttatgtctttattttcggagtctcctgtgtctggaaagctatttttcccttcttcctctacagtggtcacctcctatcagtagctttcctagataaccttacaactaaccaaagcagagctcattgctgctttcccggtgttatcatctatataaaccttgctactcagaatgtggtctgcagaccagtggcaccagcctcacttggaagtttgttagaaatgcagaatgctggacccaacctgacctactgaattagcatctgcatttgtaactagttcccatacgatctggtacggctggtcctcaggctttagaaatagcattcatcatattaatgacagttggttcttgatgcatggtctcctgtaggccttaagtttctcatgcagaaactgtatcttgttcaatgtggagccctcaaaaccttccacagagtatctgctacatagtggctcctgctaaatttatactgagggacttgatttgtattttgtcttatctaatggtcctataagaagttatgcttagaatttgggtgttttcagcactaaacccaccaaattatttatttctatgagaaatagaagcatttttgcaccttctaaaccatatcctttgaaacttgtgagcattacatgaatgtgcatgcatcacataatttggataggatttattgcagtttatgattataatttttcattatgctgctaaaggaaccattagctaaaaggatattttcataaacaaatattatagtaagggctagcctaatgtatataaaggataatatatatttttaaagttagaaattgcctctaatttttaatatgtactataaaatccacacaatttagaaattttctttgaaatcaatttaaaagaaattgttttttaaaaagtatgtaagtgtttaaatatataaaatttaaatatatactaaaatataactctgaaatttaaatatttactaggatatatacataaaacagcttgctgcattgacctggggctcacacacctcagactcttgtagaagaaaaaaatcaaacaaaacaatacagtcagtgttgcaagctgcaatatagaacagtcccaatcttgccttaggttatttgttctttttttttattattatactttaagttttagggtacatgtgcacatcgtgcaggttagttacatatgtatacatgtgccatgctggtgcgctgcacccactaaatcgtcatctagcattagttatatctcccagtgctatccctccccctgccccccaccccaccacagtccccagagtgtgatattccccttcctgtgtccatgtgatctcattgttcagttcccagctatgagtgagaatatgcagtgtttggttttttgttcttgcgatagtttactaagaatgatgatttccaatttcatccatgtccctacaaaggacatgaactcctcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgaacattttttcatgtgtgttttggctgcataaatgtcttcttttgagaagtgtctgttcatgtccttcgcccactttttgagggggttgtttttttttttcttgtaaatttgttttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctgtgtcctgaatggtaatgcctaggttttcttctagggtttttatggttttaggtctaacgtttaagtctttaatccgtcttgaattgatttttgtataaggtgtaaggaagggatccagtttcagctttctacatatggctagccagttttcccagcaccatttattaaatagggaatcctttccccattgcttgtttttctcaggtttgtcaaggatagatagttgtagatatgtggcgttatttctgagggctctgttctgttccattgatctatatctctgttttggtaccagtaccatgctgttttggttactgtagccttgtggtatagtttgaagtcaggtagtgtgatgcctccagctttttcttttggcttaggattgccttggcgatgcgggctcttttttggttccatactaactttaaagtagttttttccaattctgtgaagaaagtcattggtagcttgatggggatggcattgaatctgtaagttaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctattattggtgtataagagtgcttgtgatttttgtacattgattttgtatcctgagagtttgctgaagttgcttatcagcttaaggagattttgggctgagacagtggggttttctagatatacagtcatgtcgtctgcaaacagggacaatttgacttcctcttttcctaactgaataccctttatttccttctcctgcctaattgccctggccagaacttccaacactatgttgaataggagtggtgagagagggcatccctgtcttacgccagttttcaaagggaatgcttccagtttttgcccattcagtatgatattggctgtgggtttgtcatagatagctcttattattttgaaatacgtcccgtcaatacctaatttattgagagtttttagcatgaagggttgttgaattttgtcaaaggctttttctgcatctattgagataatcatgtggtttttgtcttgggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttgtattgattggaatagtttcagaaggaatggtaccacttcctccttgtacctctggtagaattcgtctgtgaatccatctggtcctggactctttttggttggtaaactattgattattgccacaatttcagctcctgttattggtctattcagagattcaacttcttcctagtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctcttttttttctttattagtcttgctagcggtctatcaattttgttgatcctttcaaaaaaccagctcctggattcattaattttttgaagggttttttgtgtctctgtttccttcagttctgctctgattttagttatttctagccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttcttccttcatttcgttatgtacccagtagtcattcaggagcaggttgttcagtttccatgtagttgagcggttgtgagtgagattcctaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtttaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgttgaattgatccctttaccattatgtaatggcattctttgtctcttttgatctttgttggtttaaagtctgttttatcagagactagtattgcaacccctgcctttttttgttgtccatttgcttagtagatcttcctccatccttttattttgagcctatatgtgtctctgcacgtgagatgcgtttcctgaatacagcacactgatgggtcctgactctatccaatttgccagtctgtgccttttaattggagcatttagtccatttacatttaaagttaatgttgttatgtgtgaatttgatcctgtcattatgatgttaggggtgattttgctcgttagttgatgcagtttcttcctagtcttgatggtctttacattttggcttgattttgcagtggctggtactggttgttcctttccatgtttagcgcttccttcaggagctcttttagggcaggcctggtggtgataaaatctctcagcatttgcttttctgtaaagtattttatttctccttcacttatgaagcgtagtttggctggatatgaaattctgggttgaaaattcttttctttaagaatgttgaatattggcccccactctctcctggcttgtagggtttctgccaggagatctgctgttagtctgatgggcttccctttgagggtaacccgacctttctctctggctgcccttaacattttttccttcatttcaactttggtgaatctgataattatgtgtcttgaagttgctcttctcgaggagtatctttgtggcattctctgtatttcctgaatctgaacgttggcctgccttgctagattggggaagttctcctggataatatcctgcagagtgttttccaccttggttccattctccccatcactttcaggtacaccaatcagacgtagatttggtcttttcacatagtctcatatttcttggaggctttgctcgtttctttttattcttttttctctaaactttccttctcacttcatttcattcatttcatcttccattgctgataccctttcttccagttgatcgcatcggctcctgaggcttctgcattcttcacgtagttctcgagccttggttttcagctccatcagctcctttaagcagttccctgtattgcttattctagttatacattcttctaaatttttttcaaagttttcaacttctttgcctttggtttgaatgtcctcccgtagctcagagtaatttgatcgtctgaagccttcttctctcagctcgtgaaagtcattctccatccagctttgttccgttgctggtgaggaactgcgttcctttggaggaggagaggcgctctgctttttagagtttcccgtttttctgttctgttttttccccatctttgtgtttttatctacttttggtctttgataatagtgatgtacagatgggtttttggtgtggatgtcctttctgtttgttagttttccttctaacagacaggaccctcagctgcaggtctgttggaatagcctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttccaggctgctttgtttacctcagcaagcctgggcaatggcgggcgcccctcccccagcctcgctgccgccttgcaggttgatctcagactgctgtgctagcaatcagcgagactccatgggtgtaggaccctccgagccaggtgcgggatataatcttgtggtgcgtcgtgttttaagccggtcggaaaagcgcagtattcgggtgggagtggcccgattttccaggtgcgtccgtcacccctttctttgacttggaaagggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacctggcttctgcgtcactcaggctgggagctgtagaccggagctgttcctattcggccatattggctcctccccccaggttatttgttctaagtgctgacaacatctcagattaaaagttgttttcagtgctattctttttatgttactattaatgattaggcacattttctttaaatagcttttgatcatattagttggtacagtatggattatactgcattgactacctttaagttgttgactaatatgtagatatgtttctttttttctgtacaacgttaaggaaagtaaatgactgtatcctacagaaacattaagaaatcatttttaagaaaagtttccatttctgcttgtattttagtttagttttttatccatattctgttttatagcagatgaattttaaaaggccagtctatatttaaaataggcattaattttagccatgggtgttggctttccattttaatggcctgaccactaaacatcttctttttgttgtttctttttaaaaaatatatgatttgtctagcaaatctttggtaaaaaaaatacatttcttaacagtactattttaaggacagattatgctgtgattttgctgcaacagcctcctgagtgatagagtcagatgttctactttcttattagaaacatcgatgccaatatttactttcagtcctggtctaacaaaatgaatacgttgccagaggcatatcatgagtccttccggcaaactccaaataagaaacaaacagaaatagtgaatgagaatgccaacttaaaaaaaatacgtatttttattatagacttaattggccaagaacattcctacataatctaaaattcataacgaccaaatggtaatacttttattgcctgggtggttttgtacatggacttttataacttggtattcaatgtatgaattcttgtcaatgaaacagtatcattttgtgtctgagtatttatgtgtcttttttaaccaaagaaaaaaggaccaaatattagtgttagccaaaattttaatttttaaatactagagagttatttctaaatttacgtgagtccaaattttcaagcagaaactataatcctcctttgcttacctgataatttttactgccctaatcaacttggtcttgcactactgtaaataacttacatgaggaaatattgtggtttcatgttcggtaacaataattttacctaggttttaatgaaatatctctcacaatatgagagcctgcataatatagaatatccaattcattaaacacttgcagagggtcccctctgggccatctgggattactactgcctaactttgaaggagaaacctaaccagaatattttagtatgttgcatcagtgataagaaaacttctgaacttgtgccatgagacctcagagaaggggccactttgttcatcccaaggtgactcggaatagatgacaccaaagctgaaagatttgtagatttttttataggtgaagagagagaggagggagaaggaggtacttgctggaagtgtgtcctggcaaagcaagcagcactggtaaaagcaggcagatccgacagaatgtcgtgtatggatggagaaagagaatgaaacagcagtttaagatgactggtgggtaatgcaaatttgagaagtcatgggggatgaggctggactggtaaacaagagctaagtcatcaagggccagatatcaaacaagtttatacagtgaagatttagggcaaaggggtgatgtggaagggatgagttttccaaaaagttagtcacttatccaagaatgtatccagctcacttaatgaagctagctcacttatggagctagatacattcaaatagtttctataaatcaaattccttttcttagttcagttctcctagtgatgcccaaattgacaaatttcactaggtaaaatgtttgcttttcttgaagtaatataattctacctggaagtcagcatatttttaaaaatcacaaattgtaagaaaaaaatcattttgcttatgtgccaaattttatatgtgattatgttgaagtatggaaaacagcataattcaacaaacattttattaaaattgacaacacaatttcttaaaagaaatattttaataatggttaattcctacttgttagtctataattacgcatgtttcctaattgatgaaaagaaatgaaatcactctttctggacaggcatatacttgaaaatcctttaccgtatattggcttagagaaaaattgatgttccttgctgcttaaataaatttaagcccctaaaatctgaaaacttaattgaatatttagtggacataaaatgaatggtccataagagcagaggcacaaagttgaaacagcaaagataagcatgagggactctagctttagatttttactttactcactttgttttattttccttctccacataaattgttataaattttccacttgctagaagggatttctcaagcattgcagggcagcttagtttattttcttcgtgggtaaatctgtatgtaatcattttagcaggtgagagaattcaaggaagtggtaacttgccaggaaatgagttctcagggctgtgaatgttttttcattagtggtatgatttcccaaatatcccatttcattttcgtgtaaaaggtacttttccatctcatcacgtctacattgagttagtttgcccactaggaggcactctttccaagctctgtttcccagggtgtcccgctgactttccccaataaaaacctgtgggtatttactcatcttttgtgtttttgttactaagctaagttttgtaccttgcttctgtttgctagtggaaatggccttttttgttgttgtttaaaacaaaccaacaaaaacaacttccaaatgttttggttggtacttgtttttcaaggtactagtttgtggagagatgcttaacttactagaaaaacacaatgtgtttgatatcaagtgttcactaaaagttctactattacctttaaaatagtaatattctccctgatatttattttcaaatgtaaaaacatatagatctctaagtatagctcagttgtgaacaattgaaaacattaagtcaccatagaatgcatcgctgcaaaagacaaacagtgatttgtgtcagaaaaagctttcagattaaaaaaaatcagagaatataggcttgtcgtgagttgtgtgtgtgtgtgtgtatacatacacatagtatacacacatacatatatgtatacatgtaaaaacacacagcaacaagactgtataaaaaggacacttgctcagtggcatgtgaaagtcactctcatcacacattgtgctggtcacatattgatatgcaggccccacgtatataattatacgtataaaattagagttattagtgatcccggaataatcactctctgaagacttttaatgaacttcaaattgaaagtggttggtttacttaaaaagcatgatttctcaaattttttaatctcagagcttgagacctggtcccatcaattcattcacttattgagtgtctgctctgtgtcgggccttgttctatattttgtttacggcaatgaacatacaaacaaaatttactcatggtgtttatgtttggtggtagtggtggcaaggcaggggtgcacaccagagtaggattaattgcaatgacaaagggtaatgttgtaaaaggattaagagtgttagaagcagaactattttatatagggatgccaaggaaaatgtatctgagaagatactatttgagcagagatctgagggaaatgaggaagaaagctatgcatgtagctgggggatacattccagataaaagggcaaagcaaatatagtcctgaggtttattttaagggcagtaagtgagtctggttctggaatgtgagggggagtggtgggagatgaagttagtgagatgtgccaggacctagtagaatttttctccaaatgagatagaaagtcactggcagggtttgtgcagaagagttggttgatgagactaacttttcagagaatctctctaacttttgagttgatttggtattcaaaaaccctcactattaggcctctacttggttctcccgggaagttctctgccctccaatccttctgttttttgtttaggttccttctgcctggaatgcccattttcttgtagcaggtgtgaatctcagtccacacacagagatatgtgaggaatataactatttgttcacagctgaattgagccctattctgctaggtggtatgaacaatctgtcaattctggtctcctttggccttattctgtggctgcacgtaggcctttggggactcttgtaacattgagccatctagggaggtaggcaaggggcctgtcgcaggcacagctgcctagacacagactgtagcctttctactccagaaactatttcagaaaagtagccatgggttcttactgacctcagatccctaaacctctgcaggggttttgtctgttcttcttgctggaagttggcatagtctcacctcattttttcactctctttgcttcctcttcatctctccccttccgaccctacaggtctctagatctgttctggcctagcatgggaagtcttgcccttgctcagtattcttccaggcctttgatctcttccttatcttcattctgcttataattgatgtcttccctgggcggtgaatgctgctcaatcttgctattgcttgaaggggtggagactacaacagatgaaaaggaaaaccagagggaaaaaaaccttggttatttcggaacattattctgccacttacccttctaagtctaataaaatcctgcttttcaggcccatcttgtttatcagctccttttagcaacctgcccacagctactgatctctctcatggtaggagataagcacttcctctcgtgtgttccctgggcgttttgtttgtgtcctccatcctgaaccttgtccatgggtatcatgtcaccttttgaattgttgttccagactttcaattgttgggtccttgagatcacagggaccactgcttcttcagaggtgttttgtttttgtctcagctagggctgccataacaaaatacaacagactgtgtgacttaaacaacagaaatttatttctcgcagttccggaggctggcaagtaagagcagggcacttacaaagtagattttattctgaggcctcttctcttggcttttaggtggcctctagctcactgtgtgctcacatgacctcttctgtctgtgtacttggagaaggaaagagagcaaattctctggtgtgtcttacaagggcactaatcccatgatgagggccccaccttcataacttcatccaacctcatctaaacctaattacctcctagaagccccatctctagttaccatcacagtgggggtcaaggtttcatatatgaattttggaatgacacaaatgttcaatccataacagttttgttttgttttcctttgttttcatctctggcatttatgatggtgccagttataatggagaacagtaaatgcttaatcagtgaaagtattaagcatattcacctagacaagaaatccttcctattcctgtcaataaggttcaaggctctccaatgagaaattagattgttcagctctaatgtttgtcaaaacagaagttaatactttcacatactccatagttttgcttttaagcctttttgatgtcataagaaatatagaaaattatatttgttaacaatgaggctgctaatggccaggggtgagtactagagctttgcatctctctgctacattcagttccagcttccgcacctcctagaccctgactggtatcagctggcagaggggaatagttgtaacctatttgatcatgttttgctttctaatatagagaatagagattgattatgcttttaaaaattatggaaaaccatagttattcaacagaaaaaaacctgtaaaaaatgtggcatgtgactttctaatactgcttttgttgttgttgctatttagttcttaagtctgtgggccccacaaaatttatgcccttacacctatacacataactctggtatgtgttcagcacaattaggaaggacagatgtgtgtccgaatgtcatatgactcgaggcagtgtttcttagaatgtggtttgaaggccaccttgattgtggtaacctggattgcttgttacaaatgaagtttttccagcccaggcagtgacacacacctgttgtcccagctacccaggaggctaaggcaggaggattacctgagcctgggagttgaaggctgtagtgtgttgtgatggtgcttgtgaataatcactgcactacagcctgagcaacatagcgaccaccccatctctaaacaaaacaacaaaaaaatgcttttcaagagttttagaataagactcttccatgatgaggcctgaaaatctgcatttgtaataagttaccaggatgctttttatgtaccctagactttatgaatcattgctctatgtggtgcagaaagacagtagcaatgttctgcagtattcttccaatcttcttgatttcttctgggccaagacattttggattatggatccaatttagttattactggatcattctgtttttttattttctgtatatttctaacattaattatggtgttctcctctctcacacacacacatacatgcacatacacacattctagctgtatctaaaaatatatctatctattactttcaaatttgtaaatatatttttgcatctctttaggatttttaaaaaatgacatcaattgaatctataaaaatcttccactttttaaaatgcgtgccttttttcttaagctttgttcaagttttatctattttattgatattttcaaaaaccaagcttatggttttgttgactatctctacttttattctaattaatattttatcttcttattatttattttcttctacctaatatgtttatatttttatctttacttggcttttaaattaaattatcttattttagttttgttttgtagatacaattaagtctaaatttacctttaagtatcaccgtagctgctttccaacaaattttagcatatagtgcttttcactgtcatttagtcctaaacagttaataatttctattttaattccttgaattaatttagaagtgcatttaaaatttcttaaacatatggtttttttgctactttttaattattgatttctaatttaataatattggataaaaaatgtaatatgtctaaaatgtctttattttgcctgcaatcttgcataatataataggttgacagggtataaaattctaggttaatacttatacttccttaacaccttgaaaatatcatttcattgtttcttaccatctgttgtaaccagtaagaagtttattgtcagtccattattctaatgtagataatttgtattttctccttctactagactttaagattctccagtttcattacaatatatattcatctaggtttaaccttatatatttgatccttattttttctacttagtactttgtactttcaacctaatgacttatgtatttctttaattctggaaaattctcagcaatacttttcatatacttttactatttccttcattcgctttttctggaagatttgttggaggtcttttctgtagcatgaatattacatcataattttaagccttatctttctgtgctgcattctgggtaagttccttagtttttgttaccccttcattaattcaccctttgatcccagtttaaagttatcccatttattgtatcttttaattgcagtaactgtatttttttttttttttttttttgagacggagtctagctctgtcgcccaggctggagtgcagtggcgtgatcgcggctcactgcaagctccgcctcccgggttcacgccgttctcctgcctcagcctcccaagtagctgggactacaggcacccaccaccacgcccagctaattttttgtatttttagtagagacggggtttcaccgtgttagccaggttggtctcgatcttctgaccccatgatccgcccgccttggcctcccaaagtggcgggattacaggcgtgagccacagcgcccggccagtgattgtatttttttcagttttaagctttgtgtttttcatctttacctattcttatttcacttctgactgtgtatattttatgaattcattgtttttattgacggttttgtctttattaatttctggtcattgttagcatattcttttaatacctttgtcagattgtttcataaagttaattttatctaaagtgcatttatgttcaaattgttgattttattaattgccttttatttgtacctgcccagtgtcttgatttttgttccgtttctggttcacaaaaaatgtttgcttgtatttgtccttggcatcatttttactccccaaccttatttttttaatccatcattggtatgtatttagagtggactttcctgcttgaactcattgtgcatcttgaactgagagtcccaaacagcctggttgagtaagaggggaaaataaaaaaaaaattttttggagttgtctgtcattcaatagtttttaatgtcaattaggacaaaagcaaccttttctttccttacatccatgttggtactcatggctctgaaaagtttactttgaattaacttgaagctattcttatttagattggcttaatcttagaactgtttggctgttacttataatttacttcctaatgcaatatactaccataaacattgaaaagtatggttttttggagggaaaagataacagtgagactggcgatgtttgagtgccaaaagatattacttaaagacttccccagtgaatacttgtatgaaagctttctgtgatctagtctggatatgatggtgctccctcagccagaacctctgcttaattcccctctccctttcactcaacacatattttattgagcacctattatatgccaggcactgctctatgcactggatatatgacagcagacagatcatataaaatctctaccctcttggaacctacattccagcttattgttaataatagctttgctcagagagggtttttattaatcactgaaacactgaagaaagtataattctaggattgtttattttacaaagtattggtaggaaaagtaaagtgatgattctaggatctgcttttgttatctttcaacccaggaagtatatctaggggaagccacttttattcttattacatttctagaaacctgccacaagaaatcctaaccacatacatatatacttgtgtttctctattttcgatagtaaatctatgctggtggaagactatcagttattctaatgttattgttatggatttaagataaaataagcacaggagaagactgataatctgttttatttgtctatcaatcaaaggtgccagttttagaaaacatgttcacttcttccagctttgaaaacaaagttaaactaaagcaatgaaagggaagcacattgtcagtttaaacctcaaagttacattttaaaacataatcaaagaaggggcccatatttaattagatacaagatacagattagagtttctctcattaattaggtagctgtgtgagaaatcactcttaaaagcagttttagggtattagttttcactgacttacacattttgttctgatctgctgctgtgattaatgaatttttgagcaatgacgattaggttaatttgagttcattattcaaataccagcgcctaacagatggaacactaaactgaaggtcaggaaatgtgaattccactctaggctcacagctgactttccatgcaatttgaatttcttctgctttgtgaagatatttgtggattaatgttactgtaaataaaatgctctaaatgacaaggatataaagtactatgaaagcaaatgggaaaaaatgataacttaggataaagagtctctcttcatctgggaataatatttagaattcataaacaaccttttaggggaaaatttagatgctgtacaggtggcagaattgcttttttttacttgactttaaaataataatacctgatacttgaatagtgatttccaggtttttaaacactttcttgtcctactcttatgtgaaccttagaaaagccctgtaagttagaccattattctctgtggcctcatgtggaaaatagacaataatctgatttcctggagagattaagagagattagacatatatatgttgtccttcaaacctgatgccattttagagttctccatgtaagaagttcctgtcattcttacctagcctcatatcttcacatagttcagaaataacgtgttttctcaagcatataacttggtcttcttattttccttaggccttcaaaatgcattgtcgacttgttttcttctgaagaactgttcctgtaaacagctcctagcatttattgcagactagcagagcagtaaaagaactgcagttatttcaggctaagaatctacctcccctcactgactgtcttttgaggacttggatataaatctgattctgtcttgtaaccaaaatatgagttgctttgattttgtgaaatacaagagcacactcagtgttcaaactattccacaaagagaaaatatattatctgtgttactatctagtgttcactaagaatccaagctaagtcaaaaggccaggtatggttggcatttactgtgaatttatgaatcatccatgattttgttgctgctgcttcttattccatacttggccattgccagcaatgggactttatacaggtgagttggctgagtttcagtacaatgctctgtttaattgtaaacatatatgcactgggtataaatagggtggtgttttgtaccaggtatttttttcaggtaaccaggtcaataataaattattgagtgatatactgtgatgtttttcagtttgtggattaatttcacaaactgcatggaagcaaaaagccttgctctgttataactcaaacaaaagcccacagaaggagagaaaggatgctgcaaaggctggagccagccagtttgaaccggcactagttagtagtgacacagagaaaagaggtgggaccagcacaggaaggaggagcattcacactcagaggggaattacattcagccactgcctcatttctcaggttcactgtaaaggccatttagaggatgtaatttaactgtgtggttataggcctaatgttttcacaaacttcttattcttctgtgaaggagacacagaagtagctgtttgtgctacagcagtgctttttgcatttcccctcctgagatttgcttttttcccccctcccatttagaactgaatgtggatactggtaaaatagcatccttagttttggacatttcctgagaaaaaaatgaaaacaaaaccagcttttagagaatttctaagatcatggcaaggaaaagtacttaaaaaaaaaaaagtctaagcagataacaccatccaaagcaaataaaactccttcaaaacgatatctagttacaatattgtagaatgtgcataaagaaactccatttgctctaaataaatagagacaggatatcttttataacacctggtgaaaattaaagttacaaaagactttcttaagtaaaggcagtcaaattgattaacattatatgatcagtcatgtgaatatttaaaatacaaatagccattttttaaaatgagaatgacttttaagaatgagttaaattgagtgggcaagaaggtgattataggtcttctggtatctttcaagctcatcattgtcaaatcagttctgtctcattaatttcagggtttactactactaggcagcaatccaaaactatttaaaacctgctggatggttttcactctaggagtcactgccaaccccatcccccaaccaaaaatacagggactggagacaaaactgggagaaatgtttaacacaaacactctgccatgcagacatccttaggaatttgaagattcagcaactttagggtagattctcaccagttgagttcaggtgcatatgaaataaaacccacagctaagttaggcgtgtatgttgatgtttcatttagtagatgctatccagaattaactcataatattgtaatgactttggaagtcaatatgtgatgatacaattgattttaaattttccgtggtaattgtagtcatgaaaaacctgaataatctaataatcttattttagacatcggtttcaatttttcttctcacaaagccttatattggagcaatttgcaagaaaaccatgttctttattcctcctcactctttggtagatacccatggggtaaggaattgtccagaaataagaggttgtacaagaagcctatcttatctaaaccaaaagtgaataatttgcattgttaactagccactttttcttagttgtcgactcattgacaccgtacattggccaaatattttatgaaagctaatctgtactgtagcttcagagtgctaagatgatagcaagtgagtttatgatgatcccataatctttgaagaaacttatgtactggacaataaactaacaatgccaggtagtaatcaattaagaaaactcttaagaggcagacacaataaggagttaattctggaaaaacagtggactaggtgtatttggaaaaggctataacttgagttattccctggaagaggggtcccattggctgaaaggagagaggagagggaatagtatgaaatagttatggaagattggagagtttctcagggttaatagtgggttctgagtttgagactagtgagaagcttaagtttacagatacagtggggtcaggttaaagattgtaaagttaatctttttctagatcagggattaaaaacccaaatgccttctggggccagagaagctacttcagcgaggctctagggactggcaaaaggggtggtaacaggtgaatatgtgccctaagaggaagccattatttacctccacctaatcattccttatggcaaggacttcttatttttcaagagaaattgattatctgaacgattgtgtgaagtacctggatttttaaaacactaggcaaatcaaacaaaacccattttgaggcagattttaaactacacccataactatgtaggaaaagggagtcttggagctttttagtcaggccagagataatgatgaatactttaggaaggttatcacagtggttacctattggtgattttgaatggaaaagacctgtggacccaagtcatagactccaggaagccttttctgccccttctgcaatgaagagttaggaagacatttaaataagtaatcagcaagatttgatgactgactaaactggctgtcacatgtgttctttagggtgctttggctagggggacagattgtagttctttaaagctggcctttccctgtctctcataaaagtattttttgtccacaatatctgcaccacctgcctctagccagtggtggtgcctctacaacttcacttgtaattgctcagaaaattgaacagtaaggggtgggtgggtgggttggttagttcttaaggttcttctgagatatgggatgtagtgagaaaagctttaaccactcatcttacaatcagaagacttggaatcaagtcccaattttgctacttcctggccttatgaccttggacagatcacacaccttcttgaacctggcacattcttccttatcttggggctgtggcacaagctgtgttccctgacctgcataatctctctcttcacctttacctgaccctcaccttcttgtccttaagatcacagctaaaatgtcacttcctcagagaggccttccatgaccttcccatctaaagtggagcttctatcagtttccttgggctaatgtaacaaattaccgtaaactgggtggttacatgtccaaattcaagatgtttccagcagcatcctccatctaaaaagtagggaagaatccttcctggcctccttctagctgctggtggttcccagcaatccttagtgtgccttggcttgcagctgcaacattcctaccccttcctttgtggtcacatggccttcttccctgtgtgtgtctgggtctcttcacatggccttcttataagaacatcagtcattggatttagaacccacctcacttctgcaagacctcattttatctaatgacgtctgcaaagattctatttccaaataaagtcaacttctaaggttccaggtatacatgaattgaggtgtagggggggcactattcaacccagtaccaaccccctttttaaattatctttattgtatttactatatttgtagttatatattaatttgttggtttatctttctaacatgggaattctatgaaggcaagctttaagtccattttattcatttctatatactcaatgcctggataatttttgatacctaaaagctaaccaaaaagtatttatttagtacattaagtaatcttttttccctctggctaattgtcttcattgatgaaataatggggttggaattgctagtctttaaggtattttgcagttccagtagtatgtgactctgttttttacagatgcccagtgaccccaagttgctctgtgaatcagggcagcaggcatttacatgtatacatttttttattatgatgattgtactgtaccttccctttaggtcctacttgaagaaaaagaggaaaaaataaacacatgacattgaaataccaattggtttgcctggttttgaagagagaattataaaagagataaccaaggttgtatattctgattaagtatagtaaacactcattctgtgttatgtagtaaatacactagagattatataaactggaccccaaatctaaatgtatgtcaagcagtattcacttttatgctcagactggctggtacccaaaacacctttatacctcaaatattttttctcccataggagtataatataactcattttaatttaagaagatgtaggatgattatttctcatggaagttaatttattagttcgaattatttaattgacaaactgttggaaacatgtcatcaattttgacacttttcacagtacagtgttgctgaaactcctctttgggacctttaaatgctgtcaagaagaaaaatccatttaattttattgctgagaaaatgggaagtccttttgattaaacatgattttgtttgtatttaattcaggaatatttactttttaaaattaaattccaaaatttctaagcacttaaaagatgactctgtggttaaatcgaaaataattgactatattaatatttttaggccatgactaaacaaaaagcttgtctgtaaacatattttatcttactagaaatatcaccaacacaatcatggttatagtgttgattacagatgccttcagttcaattcaacatatgtttataaatccaggccctctttaaatcctgaggttaaaaaagcaaaaccacagggcacttcatggctaatgaactgaatttcttcctattccaaaaacagattttttttttttgttcttctctgttctctttaatattctaaactggttacttcaataacgagagaggaagactgagcccaccaaaactaggaggaggcaagaccacttatttcccaccttcccaatcaagtaagctgtggttcaagcagggcttcagagggtagcagggctcctgggcctctaagggatgctcagtcacatggacttgaccaacactgagggcattggtgagagacttccataggagggcattggccaatccagggcttgttttcaacacagcagattactatcttggggccaaaagactaaaatcaaactccactgagggagggtactagatgagaaagggagcagtggatgatacctaatgccttcatcctacagatatttattgaacacctactctgatgcagagcttgtgctgggtgctgaagttatcataaagaaatataatagtttcagccagacatagtggctcactcctgtaatcccagcaccctgcaaggctgaggcagatagatcacttgagcccaggagattgagaagagcatggcgaaaccctgtctctacaaaaaatacaaaaatttggtgggacatggtggtgtgtgcctgtagtcccagctactctggaggctgagatgggaggagcacttgaccccaggaggtagaggttgcagtgagacaagatcttgccactgtactctatctagcctgggtgacagagtgagaccctttctcaaaaaaaagaagggaaggagggagggagggacaattagcagacttatacaataagaagtaatacaaggaatatgatcaaggattatcttccgaaggaaatgacgtttgaactgagacaaataagatggacaagaaccacctagaaggagaatatcccaggcaaagggaagagcacgtgcaaagaatctaaaacaagaaagggcttggtttgttcaagaaaatgaagggaccgcagtgccgcagctgagtgagtaatgggcacagtggtatagatgatgaggtgacagagtagatagggcaagatcatatagggcattgcaagatcatggtaaggctttttaattacattgtaagaatcactccattagtggagatggacaggtagaactttggcaaaagataacataatgaattgagatttgaacataatcattttgcaatatctgtgtggctatacttattggttggatttttttttaatttaattttaagtttcaggatacatgtgcaggacacgtaggtttgttacgtaggtaaacgtgtgctatggtggtttgctacacttatcaacccatcatctaggtattaagccccacatgcattagctatttatcctgatgctctccctccccccactccccacacacaacaggccccagtgtgtgttgttcccctccctgtgtccatgtgttctcattgttcagttcccatttataagtgagaacatgcggtgtttggttttctgtccctgtgttagtttgctgaggataatggcttctagctacatccatgtccccgaaaaggacatgatctcattcctttttatggctgcatagtatttcatggtatatatgtaccacattttctttatccagtctatcattgatggacatttgggttgattccatgtcttcgcaattgtgaatagtgctgcagtgaacatatgcgtgcatgtatctttataatagaatgatttatattcctatggatatatacccaaaaatgggattgctgcttcagatggtatttctggttctaggtctttgaggaatcaccacactgtcttccacaattgttgaattattacattcccactaaatgtaaattattacattcccactaacagtgcaaaagtgttcatatttctccatagccttgccagcattggttgtttcttgacttttaataattgccattctgactggcatgagacggtatctcattgtgattttgatttgcatttctctaacaatcagtgatatcgagctttttcttcatatgtttgttggccacataaatgtcttcttttgagaagtgtctgttcgtgtcctttgctcactttttaatggggttttttttctcgtaaatttgttcaaattccttgtatattctggatattacgtctttgtcagacagatagattgcaaaaattttctcccattctgtagggtttagtttaattagatcccatttttcaatttttgcttttgttctaatttttttatgttttcatcatgaaatccttgatgagtggattattttaaatgttgatgtgattctcaggaagaagttgaaacgaaaatacaggtgtagacggcattagagtattgatggatgaaagtggggatataaaagacatatgaaagaaggcccagaacaccaatatttaagggaggtaggaggaagagaaagcaggtcctgaaatagggtgaggaaggtcagtacaggcactctacctaaaagtcttatcaaacaaaggtatgtttatcctccaggcacagagaataatttttcagagtgaaacgagaatccacatgtcctatctccctatatcatcaatcattgatgttattttatggcataatgacattaatatgtagtttaaataaacatgatattgagcaacaagtattataaaatgcagatgagttttaaaagattcaatgtgacacacacactcacatgtaaacacaaaagaagtctttggcaaagatgtagccccagacttcccaggagaactcagacattcatatcctttccttacaaaggtgcttgagcagaaatgtttgagatatactaaatgaattatgacttattctatgcagctactccacaaggcagatataattaacttgattttaaagctatcactaatgaagttcagaaagttaagtaacttccctgacattattctgttagttactaggtgatattagaatttgaatccaggagtctggttccaaagtctgaaatttttatgttttataaggaggtgagctaggagcaagcaagtataaagaaagaggacatggtcagtaatataaaataccaagcagtgcgagtaggatgaggactaaaaggttatcttggccttaggtgaccacggaacctaagttaaagaacattgaagtatgttgtataccacaatgatatacaactgttcaccaactagaatggctaagattaagaagaacaaacagtggataacataagtgttaccagtaggaatatctgcttaacgtataaacacatggtatcctatgacccttcaactttattcctaggtaaatacccaagagaaatgtcccatagaaaacaagtagggatggtccttgacttacaatggggttacatcccaataaacctataagtttaaaatgcattaaatataccttacctgtcaaacatcatagcctaacctagcctaccttaaacaagctctgacacttacattagcctacagttgcacaaaatcatctaacgcaaagtctattttataataaagtgtttaacatctcaaatagttgattaagtattgtactaaaagtggaaaacagaatggttgtgtgagtactccaagcacagtttctactgaatatgtatcacttttgcaccatcatgaagtcagaaaattgtaagtcaaacatcataagtcggggccgtctgtgtataaaatatttattgcagctttattaacactagcatgaaatagtaaacaactcaggtgtccatcagaagtagaatggatacattttcctgtattcattcaatggaatactatacgacaataaaaaaagtgaaatattgctacatgcaacagtatgggttaatctcacagatacttgttaagagaaaccgggcaggaaatagcacatactacatggttccatttatatgaagttcatgaataggcaaaattaatgatgatgatgcaagtatacatgaatactttaggtttcagggtaatgagagagccttgcaaggtgttagaaaagttctataccatgatctggtttgtgggtctatactttatatgggtctgtgtgtaaactttaactataatttaaggtgagtgcaccctactgtgtgtatgttaaacttccatctaaaaaatttttaaggtgatgataaagggaaatcccaggtagaaattgttttaacaacttttctgttatgaccttataaaactattcgatcttgcaaatcatgtagtacatgtattcctcttgatgactataaaattaaaaatgaatggggaattagtaagaaacattatagatatagatgttagaggtaataaatggaagagcaagttccagaataagttactgaaaggacaggtggtgggaaaaatagaaagaggacatcaccttcccactacagggaaattctctaggggctttttgcataacagagtgcccttgcacataatggctagatttggttagagtctaatgcaagtattctgaaatgcttttgaatgataagccagaaagaagcaaaaaaaataaaattatagaatgttagagctgtaagacaaggtatattacatttcatccagcccaaccctcttattttaaaatggactgtgtgcattgactctttggaagtgactcagtacagtacagagtgctctgatgtggtgtttctttgacaaggaaggatgcctttactgaagttttgttaatcatttccagaataatgcatgttaaacatgaactttgtacaatggtttgtccatgatccctatcagcatcttaacaattgaatgtttctgaatgtcggagaactggagatacattcattaaaatgtggtacccatttcaatgaaaaatgtagtaatgaacagactttaaagtaccatgccacatcttaaactgcatttatctcctggatgaaaaggaatgtcttattcccactttaagatatattagtatatctctcttagtgtatgtatattgctatatatcaatgcaattacactgttcactgtggagaggaagtattccaggtgagaaataatagtggaaaggggtaaggatggacatatttaagaactattttatttatttatttttgagatggagtctcgctctgtcatccatgctggagtgcagtggggtgatctcggctcactgcaacctctgcctccccagttcaagagattcttgtgcctcagcctcccgagtagctgggattacaggtgcccgtcaccatgcccagctaatttttgtattttgagtagagacaggattttgccctgttggtcaggctggtctcgaactcatgacctcaggtgatccacccaccttggcctcccaaagtgctgggattacaggcatgagccactgcgcccaggctttaagaactattttaaaaatataactgatagaatttgagaaccaattatacaggataaagaaaaaaagggagtcaaaattttgagtaacttaaaccattgagtgatgcacagatgctggagtagcgggagtactttagttgaaggggaacaaaatttcaacttggcaccttgtagtgagagcttaggcttgagtatttatctctgatcaacttgcataatagtaaatgaattataaataatgtttttctgttacctgtatctctctttcttcctatggatgatatggctaattaaaaaaacaatgatgaatatttcatattataggtcacaacaaagataagcctcgctcttcttttatatcctcattctcattttgcagagcaagcaattgtgttataaaatctgtggtgaaaacataaaaacaataggcaaaagggaagctggtatgtaactcatgccttgataatggcatttgctcatttttgcatctagatggtcctctctttccaagtaggaaacatttcattgctctgtaatgtcgtccgtatagcccacctcagtgctaggtagtttctgcctgctagggaagaactagtttaattggattgtagagaggcaataagaatgcttgttttccaaaactgaattggggacaagtcagcattctggatgattttttaagtaatacatgttttgaagttacctgtggtcatttattgaggaaagagtgaattacatttctgtaattattgtggattcttgaaaatagacaataggattttaatgatttcctgacatttttaagttttaaacctaataccgtatgaccatgacttaaatagagcctagtaactaaaattttattttatttttttcactgtttactcctaaaaactagcattttacttacattaatgcaatttctgttttattaggtgccagggctatcagtaattgacatgtactatagttaataatgtatttgttaaagtaaataacttttaatggggctaccaataagtgaatgtctccaattcaaacttaaattttaaatcataggtttgtaaatatttctaaataagttagaatactgcatataacaaatgtttattcaacaactatatagtaattatcagatcttagccaatatgctcagtactagagatatgtcaataaataagatccctgccctcaaagtgcttaaaatctgaactttgattcatgaaatccaagttataaagagttgacgctatttttaagatataaattatactgtatataaagctatattaatttttccagacaatagctaaattgccataatactgtcatgcaaatcagtgggaatactgataaagctcagttatttgtaattattgaagtaagaattttctctaaagactgaagactggaatttctacagatgtaaaataaataaaagttgtatgtggctgtccaaaacttcattatactatttatatttgcccatagtctgcattgtacttttaaaattctttctctctttttagtactggttgtcaccactgccaagatagtgcctccactgctaatttctatgacctgctgctaccacctccacctccctctgttttctctctgactttcttttgatttctgccacttctccagagaaaattcaccttcattcaaaacaactgattgtctatgggtgttcttaggcagttggcatgctcttttctttctgatcagccaattgtggaataccattagttatctttgtgcccttttcatctttatttctacttgctgttcaagagtactacctttgtgttaaaattcatttatgatggagggagggggtcatgataaacactggagtctgtggaaggatgggctatcttgacatctggagcattctggatacttgaagttgctgaaaggctgatctatagatatccaggacatgtaatatgattaaagtacagttgagcttccagaagtccttgtcttactccaaatattattttatgacttaggagaaccaaattttctgtttgggacttgaactcaggtgagctgtctgtatagatagtaataagtgaaaagtattcaaatctcctctaaaatttccgccattagattcggaagtgaacttttatgtagatcttgacttgtctctcttgatttgccttgttttcttccacacagtactcctttattttatttcctatttgctactggattgtctgtatcaggacatgtttttttaagataaccacttgaattttctgttgataattgttttgtcacctattttgtcagtgcgagaatataaattttagtgttcacataaaaggaaaaccagtttagtgattattcattgaaaagaccacaattttactcaccagtgaggttcattggttagcttggaccaagtgtacgggaacactggtattaacagaaatatttttgaaagccatgtgaaaaaatctcaattgcatctccattaattcaaagaactcatgatagcccttgtttgagtttcagaagttttcgtaaagcagcataatggcagcagagaatagcaaaaagagaactgagctgaggtcaggtaagcccaatgcaagttttgtcattggttagctgtcagacctttgttacctttgctatcacacagggacaataacattataagactattatagggattaaaatgaaataacctatctgtagaaatcacagaaagcctaccacactgtaagaatacaataaatgttgattacttccctcctcatttagttgagtcaaaatattactcagtgttcccacagcgttcaatattttaggacagttctggaatttatatgcttctttctccaattctggtaatactggatttttttgaaggatctagtttatttttatcagtttgcgagttttttgttttgttttgttttttaactgacctactcagataatgaagactcttaacaattcataaatgtcttgatatttcttctctaacagtcacacaaaataaaaacagctcttgaagaaaaacaattcaaagtttaaaacatataaaaatttaggtatttaatgtaatttgaagtaaaagtttgaattgaaaataattataaaactaatatgtgccatttctttgtaataattgttataattttcttgcataattcttaaaggggaaatggtgcaaagaacagcataatagtatggtaatggttgtagaaaatttatttcatttttcattccttaaaaatctagataaaagataggaactgttttctttaaaaacctgtaggcatgtgttttatttttaaatgttaatcaaatttatgctatactcctttattttaactatgccaatggactgatcaaataattaccaatagtgattaaaaaggactttctatatttaaacaaatattaaggtaactaaggggtaactcagctaacgtggctttttaatgataacaaaatatattagatatccacatgtcatgtaaaaccttgtgtaaaatattgggctgcttttcccagccttgctttttttttttttttttaacatcctatttataaagattaaaaagcctgtgggtgagagtgggggatgaaatttagtatcccttaaagcactttgctaatgctttgatttgtatatatgtgctcactaaatgttggatctgtatgggttagcatattttctattatacgttagaaaatactaattcacttttttaaatagctgaatgagatatgaaaagacagaactggtgagttagtagctgctgctttttaggcatgccatactatcaaaccaagatagaacattttaagtaaaaacatttgaacaaaatcctaaagacatataaaggaagtcactttatgaaaaatataactgcctttcaacatctttaccttttctcgtacttgctcaaattatgactatgatgcattatctataaacataaagtctaaaaagtataaacatttgatatatttgtgcatatgttgcattttcttttattatttctattcctagtataattcaatttaggccaaaatgttgagtttagtcatgattttatatttccataggttaacttgagacatgtaaacaagtaagttatttatgtgctatataatcctctacctactaggatatttacttaatagtagttttgtggcttaggaagcagagtaattaattagagtgaattaatggcacacactggttgctatgtttctgatttgctttggactgaatctttatgttcctcaaacattgtttctgccatttagcagttgcctaacagagtgatggtatttggagatggggcctttatttgggaggtaattaggtaatgacagtgaagccctcatgaccgagatttgtgcacttagaagaaaagaccagagagagctcgctttttctctctctgttctctgccatgtaaggacataatgagacgatgaccgtctgcaaaccaggaagtgggtcctcaccagacaccagatcttctggcactttgatcttggactttccatcctctagaaccatgataaataaacgtttgttgtttaagctacccagtctctgtaataacatttgtcataacagcccgaactgactcagacacatttcttcctcattgatgagcaaataaaccaaaatcataatatttttcttgctttctgtctgaaaataatgcatttcccaattttgtattccaaagacctgtatattttattgtctatacttctggcctgctgccccaaagcagagagtcctttatatgtttgtttattcaaacatcccaggccttctcaaaataacccccaacctgaaatagaatgtgatttaaaataacagaaccttggctctggaatcaggcatgtggcaagcacacagaatatatttgttgatggaatgaatgaatgattagataaaggaatgaaaagatctgatttgtaaaatgctctcatattgaaatactttccccctctttttttatctttttataggtcatgcaacacttttgtacttgggaaagtgttctaactaaagcaattatgcaataaaagtagtctttgatgttggcttctctgtcaactttatgttggataaaatatttgggaattctgctctgtagttaaaaatatacgtgtatgtagcagggaaatgataactctctcaataattaaggacaagcaatcatatcctcgatgtaaaatgggaggaataacaattttttttaatttataagaaacagctagtgtcactgcacttagagaaaacacattaatttcttttatgttgtcaggcagagaaagtataaactttggaggttgcacagtaaggttaggcaatggcctgtgagttaataaacactattgttagatttatatagaattttattagtcttgctcagtttctcttcaattccatctaacaaggtttcctttccagcttatatgtatgcttatctaagtccaaggaattccataagaaagttgaatcaaaatattttcaattgataacttatgaagcaaaaacagcaatttcccattatatatttcaaataagtttactgtacaattttgaagtgactgtagagtctgaattgtattcagactatgtatcagttgtattcagattctggccatgtatccactaccaaaataaaatgaaaaaatgaacatggttttgtcacaagttaattgttcaacaacaataatgacaacaacaaaattatctaaaatctgaattttctgagtaacgactcagtaccatcagtaaagtagtagaatacaaaccttagtgtgctatctatgtaaagaatttaattatgttcactccagatatagagactgttttgtttccacagaattcgtaaactgtcattacagaactgagaaatgtgactttgaaaatccaaatctacgtgtaaaatttagttcaacctttgtaatattcaaatgatcttgatgtttcagcttgatatttcagccagcctttgcactcgttgttcttccttcaaatgaaggtactttatgtacttctagagaatctcctatacaaacaggaagtatgagtatgtggctttagtgatttttggagtacatgctagcatcggtgattttaagtggttattttaagtattaaaagtggttagaagcacaggctttggagtcaacagacttggctcaagtcctgaatctgttgtatcttaggcataactgtgtgacatctgtggaaagagctgtaatgttaagatgctatcaataacagcaaatgttaagatttagtattgacagaatattcctgacaattaaatattctcttaagggactgagtagaaacactagtgaaaaagatgctagcccagaaaaaaaaaagtaaacatgctatgtgggcacaaggtaatgaagaaaagatacagaaaatgcaggaaactaagtatggcattattccaagtggcacatcatccaggcaatctctactaagcataattaagcaggaaaaaagtctttccttaggtctgtgcccttggcaaatgtatttacttttattaagcctcagtttccttctctatgcaataaaaaagaagtgatctctaaattgcatatattatttaaatatgatgaaataatatctctagggcctttagcacagtacctggcacatgaaaaccattcattaaatggtaactattattattgttgctgtatttcttataaaaataaattagtacttctttggctgtataccagatgaaaaagactagtcttggtgttaatgactcataaagatctgtttctcagaagatggctttttaaagaaaagagaaaaaataaaagcatattaaaatacctctataaaaattctgtagtgagggctaattttgcttcctttttctaatttcaactgtttatatatatatatatattacatatagtatatatataacatatatgtatatattttaactatatatgttatatattttacatatatgtatatataaatatatgtgtatatatattactatatgaagtttttcctagtatcaatctattttaaagataattaactattgaagaaaaaataatagcaaagtagtgtgaggtttgcaacatatataaaagtagaatatatgccaggagatcaggagagaaaatagtaaagtatgttattgtgaggttttcatgctatatatgaagtagtatactaccaaccaatgtctttcataaacatagatgcaaatattcttaatacaatgttagcaagtcaaaaggataatatatcacaacagaatgatagctatcccaataatgcaaggatgacttaaaattcaaaaattaatcaatgtaattaataacaaactaaaataaaaatattttttatttgggaggctgaagcaggtggatcacctgagctcaggattgcaagaccagcctaggcaacatgccaaagccctgactctacaaaaaaagaaaaaataaaaaaattagacaggccagtggtgcatgcctgtagtccccagctacttctgaggctgaggtgggaggattgcttgagtccaggaggatgaggctgcaatgagccaaaattgtgccactgtactctgtcctgggtgacagagccagaccttgtctcaaaaaaaaaaaaaaaaaaaagaaaagaaaagaaaaagggaaaaagaaaaagaaatattttggataatttcaatagggaaatataattaacaaaatttaatatcaattctcaataaactcccagcaaacagcaaagtaagaatagaaggaatggtcttaacctaataaaggtatctatgaaactatgtaactaacatcatacttctatttgtttgctagggctgccatagcaaagtaacacagactggatggctttaacaacactaattttctcacagtttggaggctagagtctgagttgaaggtgtcttcagggttgacttcattctgaggcctctctccttggcttttaggtggccatcatctccctttgtcttcacgtggtctttcttctgtgcatgtgcgtgtctgtgtccaaaattttcacctcttgtaaggataccaatcataatggattaggacccattctaaagacctcttcttaacttaattacctctttaaaaaccttatcttcaaatacagttacatactgaagtactggggtttgggacttcaacatgtgaatttggagaggaaacaatttagcccataacaatacttaatgctgaaaaactgaatgctttccccctaaaattagaaacaaaacaaagatgttcatttttgccacctctatttaatagtgtgtgtttatgtgtgtgtgcatatatttttcccagcaagtacaataggcaagataagacaattagagctttctaattagcaaataagtaaaaccctatttatatagagatgacatgatcctatatttaaaatacaatgttatctacaaaacagctcctcaaactaatgtgattctgtaactttacagggtacaagatcaatatataaaaataaattttatttctatgtgtcaggaaggaatgatcagaaactaaaatttaataaaaatatcaattacaataatatcaaacatataaaagaattaggggtaaatcttttttttttaatgtgtgaaggaggtatatgtggacaactacaaaacactgctgagagaagctagagaagacctaaataaatggagaaagacactgtattcatgagatgcaagagtggatattgttaatatgtcagttctccccagattgaaattcagctttcttttgtagaaattgactacctcatcataaaagtcatatggaaatgcaaatgactaagagtaaccaaaacaactttggaaaagaataaattagaacctaacactacccttttcaagaaatatagctacagtaacctagatgatgtagtattggtgtaaacatagacaaatagatcaagggaacagattagagagtccagaaatagactcccacatatataggcaagtatccaaaggcaatttactggaggaaagatgagtctttcaacaaatggtgctgaaaaaaattggtacattattttggaaaaaaatcaaaataattatgctgagtgaaacaaactagacacaaaagagcacatatgcctatatttatataaaatttaatagatgcaaactaatgtattagaaatagatcagtgtctgggcgcagtggctcacgcctgtaatcccagcactttgggaggctaaggtgggcagatcacgaggtcaggagatcaagaccatcctggctaacacggtgaaaccccgtctctactaaaaatacaaaaaattagctgggcatggtggcgggcacctgtagtcccagctactcgggaggctgaggcaggagaatggcgtgaacccaggaggtggagcttgcagtgagccgagatcgcgccactgcactccagcctgggtgacagaccgagactcatctcaaaaaaaaaaaaaaaacaaaaaacagatcagtgtatgcctagggtggtaggggtggtggtggtgcagagaggtactacaaaaggcaggagaaaacttttggggctgatgcatgggttcattattttcattgtgatgatggcttcacaggtgcaaaaacctattaagtcaaatactctaaatgtgcaccttttattgtctgtcaatcatacatcaataaagctgttttttaaacaaacacctactatgttcaaactcgatagaattccgtacaggatgcttgccgtgttctcttttttacaaaaatgtactttaaaataattataagaatggataggatcaaattgtttttaagaacttgacagttttcgaagacattaaaattaattttatttaaaacgagatttataagaaaaattattacaataaaatcttattttaaaaattcagaggaggaaaagtttgtttatgattgaaaggaataaccaggtattaaaaagtaggaaagtctaggaatctgccgtgatcagagtaagcaggtagaatttccagttattcatgacagagttctaccacgttttgaaaggtaaacatgagttcaacctgggaagatgagaaaaagaaattctagataaaaggaagaggaagaacaaaggcaagagtcaagacatgaagaagtatgtttagggaatagcagtaaatgcatttggatagaatggtgtacgaagagtcttatggaagataaacttagcaagagaaagtggggcagatgggacttgggttttctctctgaaaatttctttgaatccccacaagcagcgctaatactctcattctcctaatactctgcattctcctaatattttgctccataccctgctacaatacttgtcacattttattgtatcatgtgtctagcttcacccttaggcacccgtctattagaaagaactacatttggctcattataaatgctcgataacaaaatgctcccactttaaaaaataggatagtctaggtatctgccatgatcagagtaagcaggtagaatttgagctggtcctttaaaaactgactagttttggccgcgcgcagcggttcacgcctgtaatcccagcactttgggaggccgaagcgggcggatcatgaggtcaggagagcgagaccatcctggctaacacgatgaaaacccgtctctactaaaaatacaaaaaatggtggcacgccctgtagttccagctactccggaggctgaggcaggagattcgcttgaacccgggaggcggaggttacagtgagccaagatcgtgctactgcactccagcctgggtgacagagggagactccgtctcaaaaaaaaaaaaaaaaaaaagggggggtggcggtcatttcaagaataattttatagggaaaggagtgagagtatccgtagtaaactgagggaggagggtgtatatattaaggagcactgagaattgaggtttataggaaaactaatatttatcattagttgttatttagcccaagcaagcggggacacatgctgtatatttaagttttctaaaaagtatttactcttcatttccttcgttggctggcacagtagagctctaagcaatcagaataagcagagaattttataagtcattttaaaaagaatatctcaaatactttttgggggaactatatttatttttcttttctcttaagttgtgtatatgttatataaaaatggaattgagaatagtattatatttgctcttggcattatatttgattgtcattatgagcctgtggtgggccatggagtaaaacgaattgagaaacagtgacctagaatgttagcacttcgagaggggactgtgctcgatttagctttgtaggcagtagcatggtgctcaagaaagaatgctgctcctgcaaatcaggataccagaatttgaatcccaatttaaatttaaaacttgtttaaggacctttaaacatgttaattatcctatagttcttccttcgttatttactaaattgggatacaaacaataatagtttcacatcattaatatgtgagttatacacaaaagaacgagggaaaacatgtagcgccatgctggtatacagcagttttctgtaatcatgtacttcatcttgcccagcacaatactttgtagatagagggtacttaagcactcattcatactgaataaatcaatgtatgaacaactgagaacctttgaaaaattccttttttctgttcatgttcaacttaatgctttcagagaactgactgtgaaaataaccttttttctggtaatctctatgtgtttgaataaaagaacaatggtgaagctccatctatttttaggttatgtagccttaaaaatgagaaagctaaatatgctgggagattttatttattttgttttcttggtctcattttatttctgtcttaaattaagttaatgaaattttgggtaggcctggtcacatttaatacctagttctccaagtattttttgtgcatcccttttatagcagtgtgcaatgtgacagctcagcctcctcttgctgactaatctcctgtacagacagaagcaattcccataattcagataataacctggaacaactttcatgatttacaaaagtagatttgtaactgatcttcttataatttagaaaaggagattagagtgtaataaaatatcaaatcatagcttaggaatagaattttggatgttaaaactattctgaaagtaaatacagttttaaacaagaacctgtactgatttaattgcttcaaagaaaacatattgaaaaagaaaagaattatttaagttagcatatacttataaatagtttcatagaatgtttaaagctaaacatattcaattataatttggattacactattctattacataacaacctacataagttgattagaacaaaactacgaagtaaacttcaacacaatccatataatagaatctgaattagaaaggcttgaatttattgtatgtaaatttatgaagactttatggaaatagatgcacctttgtaaaaagacagaacatgaaatgttaaaatgattgcttttttatcctttatttatttatttttgctaaaccataccatactcttaagtcatagttccagtgcttagtgcatagaaggtgttcaaggaataattgtggaatttaggaaggtttaatttctgacctataataaaggtcagaataaatggtaaaattagacaaaaaagtcaaggaaaatataagcataatctctaataattcaaaagctatgttgtggtgcattctagaaaggtgaatttgtggactttttttttaagggaactcatttgtatcagattgtcaggaaataatgttacataaatttctattttctgctttaaatgctggcatgcgttctttttaatagtgtgtattacaaatgcaccaaatctagggctaagtaaacagaaagttgaatcaaggtacttctcattttaaaaattgttctggagtcttggagtagaaagggactttggagttgatttttcccaacttccttctattattgatgagggaagtagaaggggaaaatgactcgttcactgtctgtagcttgaaaaaaaagattttttaaaaatctatacttgatcaggcaggcacaggaaggtacttaatgaatagtttccaagaagagtcacttcggcataagagatacatattgtagattaatttacaggcaatatcaattatagtaataaattattggtgattattaataattattaattttaaattagcatgttgggtcttatgtaattgactgaggaatcaggttaaggtgcatctttcattgtgaaattgagattttgggaacatgcaaagcctcactgcagatcctaatgaatttaccacagggatgctgccctaccaatacacttgagtagaaattttcaaggggagttgagggacatgtccttggtaacaagaggattggggaagggtatatttcacttgaaatttaaacaacattttgttccatggtcttatttatttttgggcacattattgtttttttaataaattcaaatagcattaaaagcattcatgttttctttttaaaagttaagaggttttaaggcataagtcaactagttttttcctctgtccttttggaataaatcattcattcttttaataaacgcttattgatcatctctatattccaggcatagtggtaccctctgaaaatacagtcaaaaagttgattcctgtctataagggggagccagagtttattcattgagaatttacagcagaatattattgctccaagtttccccctgccatctacactcatcattgcaatatttgacacagtagtcatttattggagaaaatacaaaaagatagaaatcacaaagagtctttcacttcacttgctcattactcagcaagtatttattgagtacctatcatgtgccagtcactgagctaggtgcttgggttccattagtgagtaaaacagtcaacgatcctgtctttgcagggattatattctaggaggtgagactaatagccaaaaaaaaaaaaaaatgcaaattacaaagcatgttagaaggtgatgtgtgctggttaaaaaagagagagagagagtgagagagaagtagagttaggggaattatgtgtgtgagaaggaaatttagtgtggtcaagagaggcctcattgtgacttttgaacaaaggcttgaaggcacttgaaataaaaatccaaaaattaggataaccatagaatttgaatttttaaactcattttaagtctattttgttatctatgttacttcctggcaagaggctgcaggtgatggtaaagtcaaggattttatttttctttcttttctctcccattagctttgattttcacaaggagtggcatttccactattttctactttgctaaaataaatgtatttcatgggatttttgttcatcaatgataagaacaaggtttactttgagaattttctcttgagagcctagagcaacatgtagcataatttcatatcatgcgctgtttcttagaaatataaaaatccatatattgccatttttagaatgactcttagtcatatcagtttgggcaagaagtcaacttactttcacatggaatcactgagtcatagatttagataagaaagcagtttactttcttaatattcttcatcgattttagcatattttaaaaatagaagtatctgtttcttacagattctgtttctggcgtctgcatacgcaagtccccaactcgctgaggagagctgttcagctatggctgctgtcacacattacctgtatctttgccagtttagctggatgctcattcaggttggtacctcattccctctccccgcccctttaatcttttaatgaatctgggtggagtggtcttaatgtctgatactctgtactgaagtagaagtaattccgtatatccatcactgcattctcaggatataaatgacaaataaaaacaccctataagctgtacaacagtagagagcattgtgagtttgaagaaatgatggaaatctagtaggattggaaacaagggagtggttagagatgaagtctgcaatgtgggccctttaaagcacagttggaaatttgaacatttttctaggaaaagtaatagaatgattttaagcaaaggagtgacatgataagatttagattttagaaagatctccctgtttgtagtgaatatgagacaggaaagagtggataggcaagccaattaagtagatttagctgtattcatggggaaatcatggtagcgtgaactaaggaggtggcagtagaagcaaagggaagtggactgttttggagatttttttaagctagaactataggatgtgaagacttgttgtggggaatgcagaagttggaacccaggatgcttcccaaatttctggccgggtatctggtggatagtggtaacagaaattacgatcactgaacaatggggaagagctggtgagtttcgtttgggacatgctgaatgtgaagtgcctatgagacttccagtgggaactttgaggagagggcgatacatttagaaatgcactgggaatgccagtgctttgggaggccaaggcaggcggatcacctgaggtcaggagttcaagaccagcctgtccaacatggtgaaaccccatctctactaaaaatattaaaaattagctgggcgtggtggtgggcacctataatcccagctactagggaggctgaggcaggagaatcacttgaacccaggaggcggaggttgcagtaagccgaaatggcaccattgcactccagcctgggcgagaaaagcgaaactctgccaaaaaaaaaaaaaaaaaaaatagaaagaaagaaagaaatgcactgggaagctattggcttagagttggaaaatggagccattggtttggaagagattacttggcgagaaggtacagagtgagaccagtagagtcctagcatactcccctgaggaactagtaaatgttgggggagaaatttcaattttccttttctaaataaaatcccaaattctctccattattctatgctgatttggtcgataaagaggctaagagaggaggatggtgcgtagtatttaagtggctcaactaaaatgctgcctttggtaatgcattctgtgtaatggtatttttaaggttttcatgtgatactgtttcatatgcatttctgagtatggatgtaaactattttaatgaaacagatgcattcaggcccttgcatattcttttttcttgttgaagaggaaggttgtgggacttgatgatgtagcaacagtgaattaatggtaaaaggagaaagaaagtgaggtggtggtattatgagagaataccacataccacacaggctcaaggaagggttgttttccccagtatgatatgatagtagtgggggctgaagaagagaactgaactatttagctaatagaactagttgaaacaagtggcaccctggatctggatttgaattctggctctgccactatctgtgtaagcttaatcaagctattgactctctccaagatttgtttctaaatctgcatatagggataataattcctaactcatagaattattattaatattttatagctctttgagcagttttaatcatggaaaattaatggtgttttcaagctcccctctcaaaaaaatttgcaaataaaagtgaatttaaaccatataacataaaacttacatatctgctgaaattagaataacatttgcgagattttctgattgcaaaattctgtaagagtttatctgagttaaacttttttaaatgtgccctatttatgttgttatctgtctgcctgtattgaggtccccagtgctatgctaaaggtctttgtccatgcccctgacctattcagaatttttgattcattacttggatgaaaacacaggaaattgcttatcagatatgtacgtggtacagaactgaaaggacagctgcaacagagagctgcctgcattaagattacaagtagagccaatgaagagaaactgtactgtgataaattaaaaactagagtgaaagagacatcatctgatggaagttaatgtaaattactcaaaattataatttaacataaactcagcagcaattgaatatgtgaccagaatgcttaacaataacaactactgtaactacaaaaacaacacacacctaggttgcgttgatagcagtatggaagcagacatgtttacgttgtaatttacaaaattcagactattttgggacatagcaaccactctcatgggtcgtgtttcagcaggaacattaattatccaatgagaagttggaaaacaaccccctaagaaactttgaggcagctggacataactaacctggaaagaatttaggtaaatgtgatggctgtctacaaataccggaagggctactgcaggaaagggtggactatgtagctccatttggcacaactcagagcaaatgggtcaaaaattagggaaggaaatttttgattcaggttaagagtgttcatagcaataaaactgtcaaagttgaagaggcttttctaaaagtagagtaaattcaatcactgaaatatatggagagggaaatgaccaactttcaaacatgttttagatggattttctgctttcaggggcattagacaaaatcatatataagatttcacccaagttaatgaagattggtatattctacatctcttctttgagttaggtaaatatgattgtgcctgattcacatttagtagaccaattagattctggatggctaatggcttaggaaagctatttaaagtaccagtgaagtttaatgtatttcagatggtacaccacacatttttcatggtttgtgatttgaccacaagggaaaaagtcagtcagttctgaattctagttaggttacttttaatgaattattttatgatcagaggttgcacttcaccaacctacatattcccatttataaaacagtgactgctgaaatctttttttttctaaaatccgttttaaaaacattatgtagaaggttagactattattagttcaatcctattagttgaattaggttgaataaaattgagagaagtttttactttaatgattctacttcatttttttagtaatataggagcgaatatgatactacatatgtctgtgcatagcttataatgacaataaattaatcattaatttgtaattactgagttaagcatgtcagaattgttaacgtttatttttatctgcgtatcttcagtcttagaataaatacattgaaatgactttatcttgaaaattattttacttttatatcctatacttttagtgccatataataaagttagattatattttagagtagcttagggaaaattttattggtaaacaagttacataacctctctgagccttgattttcttatttgaaaactcaagttgtaataacagtacctctctttacagactgtgaaaagacaaaatgaattaatgtatagaatgaacttgaaatggtgtctgggacagaatgcatactctgtacatatttacccatattatttgttaagataatatgttgtggctaaaatttcatagatttgaaaacatcttgaatactctgctattccaatataaatttataccttctttttaaccaaagaagatcatcttcatgtagtggaaagaggtccgactttgagtgaggtggacactaactagctgcaaagccttagcaagctggagaacctttaactccttattaaagtagatgcatggctcataacaggctccataaatagcagccttgcctctgtttcttcaggcttcccttttctttgacagagaagtcacacagtgcaaagcgaggatgtattaacaaattattttgcttattttttaaaaggaaacaattcataaattcctttcttggccatagatattgaattatccatctgtttgctcttcatgtaagatcactccttgaaactattgaaatcatttctcccttaagaaggcagggttggggcagttccaagatggccaaataggaatagctccagtctacagctcctagcgtgagcaacacagaagacgggtgatttctgcatttccaactgaggtactgggttcatctcacggggcctgatcggacagtggaggcaggacagtgggtgcaacccaccgagcgtgagccgaagcagggcgaggcatcgcctcaccagggaagtgcaagcgatcagggaattccctttcctagccaagggaaggggtgacggacagtacctggaaaatcggatcactcccaccctaatactgcgcttttccaatggtcttagcaaatggcacaacaggagattatatcccgtgcctggctcggagggtcccacgcccacggagcctcactcattgctagcacagcagtctgagatcgaagtgcaaggcagcagcgaggctgggggaggggtgcccaccatggctgaggtttgagtaggtaaacaaagcagcagggaagctcgtactgggtggagcccactgcagctcaaggaggcctgcctgcctctgcagactccacctctgggggcagggcatagccaaacaaaaggcagcagaaacctctgcagacttaagtgtccctgtctgacagttttgaagagagtagtggttctcccagcacagagtttgagatctgagaatggacagactgcctcctcaagtgggtctctgacccccaagtagcctaactgggaggcatcccccagtaggggcagactgacacctcacatggccgggtacccctgagacaaagcttccagaggaacgatgaggcagcaacatttgctgttcagcagcctctgctgctgatacccaggcaaacagggtctggagtggacctccagcaaactccagcagacctgcagctgagggtcctgactgttagaaggaaaactgacaaatagaaaggacatccacatcaaaaccccatctgtacgtcaccatcatcaaagaccaaaggtagataaaaccacaaagatggggaaaaaacacagcagaaaagctgaaaattctaaaagtcagagcacctctccccctccaaaggagcacagctcctcaccagcaacagaacaaagctagacggagaatgactttgacaagttgagagaagaaggcatgagatgatcaaacttctctgagctaaaggaggaagtttgaacccatcgcaaagaagctaaaaaccttgaaaaaagatttgacaaatggctagctacaataaccagtgtagagaagtccttaaatgacctgatggagctgaaaaccatggcacaagaactacgtgatgaatgcacaagcctccgtagccgatttgatcaactggaagaaagggtatcagtgatggaagatgaaatgaatgaaatgaagcaagaagagaagtttagagaaaaagagtaaaaagaaacaaagactccaagaaacatgggactatgtgaaaagaccaaatctacgtctgattggtgtacctgaaagtgatggggagaatggaaccaagttggaaaacactttgcaggatattatccaggaggacttccccaacttagcaaggcaggccaacattcaaattcaggaaatacagagaatgccacaaagatattcctcgagaaaagcaactcgaagacacataattgtcagattcaccaaagatgagatgaaggaaaaaatgttaaggggcagccagagagaaaggttgggttacccacaaagggaagcccatcagactaacagcagatctctccgcagaaactctacaagccagaagagagtggggaccaatattcaacattcttaaagaaaagaattttcaacccagaatttcatatccagccaaactaagctttgtaagtgaaggagaaataaaatcctttacagacaagcaaatgctgagagatttcgtcaccacgaggcctgccctacaaggggtcctgaaggaagcactaaacatggaaaggaacaactggtaccagccactgcaaaaacatgacaaattgtaaagaccatcgatgctaggaagaaactgcatcaactaacaagaaaaataatcagctaacatcataatgacaggatcagattcacacataacaatattaaccttaaatgtaaatgggctaaatgctccaattaaaagacacagactggcaaattggataaagactcaagacccatcagtgtgctgtattcaggagacccatctcatgggcagagacacacataggctaaaaataaagggatggaggaaaatctaccaagcaaatggaaaacaaaaaaaggcagaggttgccatcctagtctctgataaaacagactttagaccaataaagctcaaaagagacaaagaaggccattacataatggtaaagggatcaattcaacaagaagagctgactatcctaaatatatatgcaccgaatacaggagcacccagattcataaagcaagtccttagagacctacaaagagacttagactgccacacaataataatgggagactttaacaccccactgtcaacattagacagatcaatgagacagaaagttaacaaggatatccaggaattgaactcagctctgcaccaagcggatctaatagacatctacagaactctccaccccaaatcaacagattatacattcttctcagcaccacatcgcacttattccaaaattgaccacatagttggaagtaaagcactcctcagcaaatgtaaaagaacagaaattataataaactgtctctcagaccacagtgcaatcaaactagaactcaggattaagaaactcactcaaaagcgctcaactacatggaaactgaacaacctgctcctgaatgactactgggtaaataacgaagtgaaggcagaaataaagatgttctttgaaaccaacgagaacaaagacacaacataccagaatctctgggacacattcaaagcagtgtgtagagggaaatttatagcactaaatgcccacaagagaaagcaggaacgatctaaaattgacacgctaacatcacaattaaagaactagagaagcaagagcaaacacattcaaaagctagcagaagacaagaaataactaagatcagagcagaaatgaaggagatagagacacaaaaaaccctacaaaaaatcaatgaatccaagagctggttttttgaaaagatcaacaaaactgatagaccactagcaagactaataaagaagaaaagagagaagaatcaaatagatgcaataaaaattaataaaggggatatcaccaccgatcccacagaaatacagactaccatcagagaatactataaacacctctatgcaaataaactagaaaatctggaagaaatggataaattcctggacacataccccctcccaagactaaactaggaagaagttgaatccctgaatagaccaataacaggctctgaaattgaggcaataattaatagcctaccaaccaaaaaaagtccaggaccagatggattcacagtcgaattctaccagaggtacaaggaggagctggtaccattccttctgaaactattccaatcaacagaaaaagagggaatcctccctaactcattttatgaggccagcatcatcctgacaccaaagcctggcagagacacagcaaaaaaagacaattttagaccaatatccctgatgaacattgatgcaaaaatcctcaataaaatactgacaaaccgaatccagcagcacattaaaagcttatccaccatgatcaagtggacttcatccctgggatgcaaggctggttcaacatatgcaaatcagtaaacgtaatccagcatataaacagaaccaaagacaaaaaccacatgattatctcaacagatgcagaaaaggcctttgacaaaattcaacaattcttcatgctaaaaactctcaataagttaggtattgatgggatgtatctcaaaataataagagctctttatgacaaacctacaaccaatatcatactgaatgggcaaaaactggaagcattccctttgaaaagtggcacaagacagggatgccctctctcaccactcctattcaacatagtgttggaagttctggccagggcagtcaggcagaagaaagaaagaaagggtattcaattaggaaaagaggaagtcaaattgtccctgtttgcagatgacatgattgtctatttagaaaactgcattgtctcagcccaaaatctcaagctgataagcaacttcagcaaagtctcaggatagaaaatcagtgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggacacaaagaaatggaagaacattccatgctcatggataggaagaatcaatattgtaaaaatggccatactgcccaaggtaatttatagattcaatgccatccccatcaagctaccaatgactttcttcacagaattggaaaaaactactttaaagttcatatggaaccacgaaagagcctgcactgccaagacaatcttaagccaaaagaacaaagctagaggcatcacactacctgacttcaaactatagtacaaggctacattaaccaaaacagcatggtactggtaccaaaacagagatatagaccaatggaacagaacagagccctcagaaataataccacacgtctacaaccatctgatctttgacaaacctgagaaaaacaagcaatagggaaaggattccctatttaataaatggtgctgggaaaactggctagccatatgtagaaagctgaaactggatcccttccttacaccttatacaaaaagtaattcaagatggattaaagacttaaatattagacctaaaaccataaaaaccctagaagaaaacctaggcaataccattcaggacataagtatgggcaaggacttcatgtctaaaacaccaaaagcaatggcaaccaaagccgaaattgacaaatgggatctaattaaactaaagagcttctgcacagcaaaagaaactaccatcagagtgaacaggcaacctacagaatggtagaaaagttttgcaacctactcatctgacaaagggctaatatccagaatctacaaagcactcaaacaaatttacaagaaaaaaacaaacaaccccatcacaaagtgggcgaaggatatgaacagacacttctcaaaataagacatttatgcagccaacagacacatgaagaaatgctcataatcactggctatcagagaaatggaaatcaaaaccacaatgagataccatctcacaccagttagaatggtgatcattaagaagtcaggaaacaacaggtgctggagaggatgtcgagaaataggaacacttttacactgttggtgggactgtaaattagttcaaccattgtggaagacagtgtggcgattcctcaaggatctagaactagaaataccatttgacccagccatcccgttactgggtatatacccaaaggattataaatcatgctgctataaagacacatgcacgtgtatgtttattgtggcactattcacaatagcaaagacttggaactcacccaaatgtccatcagtgatagactggattaagaaaatgtggcacatatacaccatggaataccatgcagccataaaaaaggatgcgttcatgtcctttttagggacatggatgaagctggaggaaccatcattctcagcaaactgtcacaaggatgaaaaaccaaacaccgcatgttctcactcataggtaggaattgaacaatgagaacacttggacacagcaaggggaacatcacacaccggggcctgtcctggggtcgagggaggggttagggaaagcattaggagatatacctaatgtaaatgacgagttaatgggtgcagcacaccaagatggcacatgtatacataggtaacaaacctgcacattgtgcacatgtaccctagaacttaaaagtataataataaaaaaaaaataataaggcagggttatatctactttaagaaaaattgacagtaagaatttaaaatcttgcagtatctttactctgttttgctagttctgtttttccttcttctgttctgatttggtttcattttagagatagcatatactaatggtacaaaacataatcgaatactaaataaaaagtacatctttttctcactatttcttgcattctccattctttgctctaccctcaatgccaattcctgaaagtaaacactactgttttcctgtgtatctctccatcaatattccatgcatagacaaatatttataaatatttaaataagcagacatgtgttcttgtgtgtgagtgtgtatatatatatatatatacacaatgtacatatatttatatatagtgtatatatgtttacgtgtatctgtatgtgtgtgtatatgtgtgtgtgtgtgtgtgtgtgtgtatatatatatatatatatatatatatgtatatgtatatatggacatctttaagtttaccatgcatgggtatacctttttcctatgctataatatgattattacataagttatttttctggcttccagttgatgaaattacattattttttgggtattgtgttactttttgctatagtaaacaatgtgtccttgaacacccttgcactctgaatatttgtttacttgagccatatccatagaataaattcctaggaattatgcctttgctattcatgtctacatgaaacatgctctcagttggatttccaaagcatgaggtaaataaattgcaagtaaattatttgagatattcatatatgatataggtaagcagacaaatgatttttgcctgtatattcatttggccgaattttatgatcacttcctgtcaccaagttaaatgattgtatagcagtctgcatcagttatgaaagatatacaacccttgcattgtttttgcagtctgctcatctcatgcctagagtcacagcttaatttgaaatataatcttttcttttgaaactacagcttaattgaagaacacatttttaaaatggtagaataaggttagaaattattttacagttgtacttgagcattcacatcttgtgcgttattttctcaatataaccaggctatgaacaagcaaatgtgcgtgttatttattccttggtagaaaggctacttagtgccagagcatagcaaaacaggaaggaaaatgctaaaattagccttgtttctcgttcatcgttgatttaattttgggggacatcaaaggtattaaggacaacagactgggaattatcaagataaaaatgacatacccagaaaatactgaattctccagtcctcaaaaagtcttgcaatttatttcatgcaataaatgttaagaaagagggaggagaactggggcaaggacgagggataacatttcttagactcccatctgaaatgaatgattaagggcatatggaatagacagaattaatagcatctgtgatctgtaactaaacttgttgctatagtcagtttgaggattctggtgacacagttaataatcaactattaaacaacagtcaggataccaatctttatttcatataccatgaaaattatggagttcaaatagcctatttttaactttaaaaggcatttctcctttatattttactcatatgctaatatgcattatatgaagatatatgaataagcgaatgaatgtgtgtttatggaacatatgaaatcataactatggcctatgacaatcaaaacacttaacaagatatgtcttcaatttttctatctggatattgggaaaaatagtagggaaaatgttattgtaaaaataaatagataggtttgtgtaggaatgtaagtaaatatgcttatagacacagtcttttagtttactgctatctatatttgacctaaattatatctgggtatttcagttggttgcttgcatttaacacagaatcagtttaaattccaatagcctgaattactaattctgaaaagtatacttctcccatcctccgtttcctccggtgtaaacagaacatagtaaaacctagggggaaagtcttgattaaatgatatataactttatgtttggcctacgtttattaatcaatgaataaatatttgttttgactgggcacggtagctcaagcctgtaatccaagcactttgggaggccgaggtggggggatcatgaggtcaggagatcgagaccatcctggctaacacagtgaaaccccgtctctactaaaacacaaaaaattagccaggcatggtggcaggcgcctgtagtcccagctactagggaggctgaggcaggagaatggcgtgaacccgggaggcggagcttgcagtgagccgagatcgcgccactacactccagactgggggacagagcgagacttcatctcaaaataaataaataaataaataaataaatatttgtttcattcttcccctcttaaactattaccttcaacgtttttcacttttcaccagttaacttctgtccttcattgggagttcagccaaatcgattaaaattatggagtcttctaaaattctttctggaggagatggttaatgggcgcaaaaatatagttaggatgaataagatctagtatttgatagcacaacagggtgattgtgctcaacaaaaatttactgtatattttaaaataatgaaaagagtggaatagaatgttcctaatgcaaagaaataataactggttgaggtgatggataccccaattaccctgatttgattattacagattgtatgcctgtatcaaaacatcacacttaccccataaatatatacctattgtgtacccattttaattaaaaatttaaacacatttaaataaaattatttttaacaaggtggcatatatatgtatataaacaaactcaaaactaaaccaaataaattgtaaaattattgttaaagtcaataaaatgttttaaatgctcaaaacaaattgtgtacatcttcatttatttcatatttctcaattaaaattatatgcaaagcattttaataggtactacaaggtaaagaaaaattaatccatagttcacaattgttttgggtattatattctgataagcctttgtaagttttccttaagacttaggaaaaaaatgaagatacagaacaaattatctttttacttctacaagtaaaacatatctccactggcatttaaagtgagtggtgaaaaaaaatgagaacaggaagttctcatgtaaataataatattgtcaatatttgtgtcaatttctttttttttttttctttttgagatggggtcttgttctgtcactgcagctggagtgcagtggcgcagtctcggctcactgcaacctccgcctccctggctcaagcaatcctccgccttatcctcctgagtagctgggactacaggcatgtaatcatcatgcctggctaattgtttgtattttttgtaaagacggggtttccctatgttgcccaggctgatctggaactcctgggattaagcagtcttcccaccttggcctcccaaagtactgggattgcagatgtgagctaccgtgcccagcctatttgtgtcaatttatatggaaataaatcttaaatataatcagcctttacaaggcagtttggagtatgttgcactcccagttctatagctaaccagaagatgaaaaagctatgctgttctttcattgcctcagtttccttataagagggcatggtaagatgacttgtaagatctgtgttgctgctaaaaaaacatagtctgcatacatccatgccattagtgtttttacttaaagaattgtcatttctgcaataatcaatcacagtgttaggaaattatgaataactaaaaatgtaacctctccttttaccacagaaggaaattaaaacccagagaagccaagtgaaattggccaaaaagcagtttatccattgcagaaccatgtcaaagacccaaatcaagttactaataatcatgtccttttgaattttgtagatttttaaaaaatatataacatctatataacttattattcacctggacctttacttctggatgagtcctttgcaaatcttccttttccgtatttgtatagattgtgtttgtaataggaaattttcaaaaatagcattacatagttttctttacatttattaaaatgggctttcaattaggtactcccaagtacagttacctaggtgatcatgatatgctggtaattgtgagaagtgtgagaattcaagagtacatcatctttcctgataagcaacaatgaaaataagaagatggtagctctaatatactaatgtttagagttattaaagatgagactatttagtaacatcactgatttttaagctaaaaaaattttcatttaattgtctctttccaactgacaaatttggtggtttataatgctgaaaatattttggaatttttttggacttgtcttcagagactatatcgtatctgtttaaatgaccttaatgctaggaaactttgtattcggagtgtgtatgaaatgtagaaacagtcaagtaggatgaatttagttggttaactttgggcataataacatttcggctaaaaatgacatgactacattgtgagggtgggtggtcttaagatagtttataagatccttctaacaacattttaaaagcttagaaacagaagtgtaaatagagacctacatattgaatattttagtacagtctttagcagaaaacgtgtaagataaacagtgaacagtaagctatgtttagttagcatgaagcatatttaggtgagcgacaccctttgacttgcgttctgttagttccacattggataaacgcatagtcaatcaggcacacagatcacatttgctatatatctgttaacattaaattattgtgcaaatataatgatctgttaatactcttaagttagattatgaaggaagaacagtgatttcaaggaaaggaatacaacaggtcctcaagtaatatcatttcattcaatatcgttttattgtaacattgatgagaaaataaataaattgctagccttggttactctctgtgagatgtgaaccctgaaaatttgagacaggtctcagttaatttagaaagtttattttgccaaggtttaggacacacgcccatgatacagcctcaggaggtcctgataacatgtacccaaagtggtcagagcacagtttggttttatacattttagggagacatgagacatcaatcaacatatggaaggtgaacattggttcagtctggaaaggcaggacaacccaaagcagaagtgggaagactcaaagtggggagtgggcttccaggtcataggtagagaagatacattttttgaggcattattttgagtttctgattagcttctccaaacgaagcaatcagatacgcatttatctcagtgagcagaggggtaactttgaatagaatgggaggcaggttggccctaagcagtcgcagcttgacttttccctttagcttagtgatttgggggccccaagatttattttcttttcacagtggagtttgcatgttctccccatgtttgcatgggttttctctagtacttgggtttcctcccacatcctaaagctgtgcacgttggcttaattggtatgtctagatgttcccgctctgcatgtgcatgggtgtgtatgtgtgagtgcaccctgtgatgggatgacatcctgtccagggctggttcctgccttgtgccctgagctgccagaatgggctctggtcatccttgaccctgaactggaataagcaggttataaaatgaatgaataagtgaatacaaattattgtaaaataaaaatttataaagtatatgaagaaagtaaatcatgtaaatgcaggacaataaacaatgctgtacagaagtgcacagggagcctgccatgtttgtgattgtttttgacatgcctagtggtagaaggtgctcctgacaattttcactgtgcaaacattgattccttgatttaacccaccatcatgacaaccagtggcactcattgattcaccaaaacctggataaattacttacttgagaggctgaggtgtcaggattgcttgagcccaggacttcaaggctgcagtgagctatgatcatgcgactgcactccagcctgggtgacagagcaagaccttgtctctaaaaaaaaattttgtaaaaataatcatctcacttgttcttatccatctttcttaaaggtatgtataggtcacacttaattcattgtttaatatgagaagtatttaggtctttatttagaagcttggtcattgttttgtgaccagaaacatgccataggaacttaactcttttctgtatcagttaatctatggtaacgttggtttcatgatactttgttttgcttaattttgcagtttccaagaacctattgatggtattaagtgaggacatattgtatagtcaaatgctccaccatcttcttttggtttttaaaaaaaatggcagtaactagagattttaacaccactgctttgggaaagcaatacattaatacatctcattcaagttttgggtggaagaagaaagaaaaactaagttaactaagttgagctaatgtaaacaaacattgaaattgtaaaggcattttggataactcattgaacctaagaactgtaactacagttagacctcacagggactgtgagcattcttctctactaacacacctctgcttcactgccctcatggctacgccctttctatgtccacttacttcagtcgaccagcttagacactcatggaacatcaaggaattcagtgtagatgattggctcagccgggccaggcttctcccctgattaaatcagctgtggccaggggagcaatgtcagggagtacacagagcacactgagcgcactctgcatgtggtgggaggagggttagagaggcagggtttggaaaagggctgctcatgagctaggcatttgtccaaaaatgtgcctaccacactacattaaaataaaattcaagtaaaacttgaaatgagctagtcaacacaaatcttacgtttggcctatgtaatgtttctaaaataattaaatgttgttccattacattctagtatttctagtccatagctttaaaaatgatatattatgggaaatacttctctagagtatatttcagtgatcatattcttttaagaagaaatttaaattattttttatttataattggcaaaagcttatgacatttgaagcttgttttacttaatcaagtattcagtaattcagccactctgggccttgagctctttgggacagaagcactgcatgtataaatctaacaattacatttgtctcagtcttatctgagcctgtggtcaaggccagacagctgctgacaggttgagtaattctgactgatggaactaatgtccttctgcgtaaaagcagacattttgaaaatgtctcaatctttatcatggtgaatcagcttagagtcatttagcaatctgtaccctcctccttgactcttccacctactgcaccaccgagttacgatgtcacatggatgcacacaagcatctatccaacataaataattagtacttttgtttagaagatggattaatcaatgattcttgctttgtatgaattttcattctttaacaggcagtattgattaccccagcaacaacactttacacaaccccgcttatttgagtccacatccctatattaattatagaaagaaaaaaaaagttggatctagtaatttttaaaaatgaattagaacaaagttacataagcaacaactcaaaacatgcttcataattacagatataagcagatgtacatagagatatggagtgctggcaggaaataaaattcagagacacaaatctctaagtaaccaaacatttttatccttccctggtttagcctaatactaatccctcaaggctaatttggtacagatacaatcttactcagaagcctcagtaaataaaacatctgaaagccttcccacaaacattaggaatgcttatttttcaaatagaaaagtgtttatcttttgtctttcacactgtctgacctcttaataagagatttaagaagaggcagtcacattttccagcattgactatgtatgtgctcagcactttacatgtaacatctcatttaatctttataataaccttgttgtatacatgcaactgaggctctgaaaatgttgtgacttgcccaagattatccacttaaagtataacattaatgagtatgaatgaattatagacatataataatatagacataatatataattcattcatactcacactctttctaccatacaaaattgagaaggaggatttatccaggcaataagtattactgtttgaaatatgtatggcatggcattcaatattgttactgtactaaatgataattaaatatgagcattccttatggaaagaagacactagaagacttagatccaagttaggtgtgggatttggagccaacatagcatttataggcctcagttttcttactcttatttatttaatgtgtcccctcatcccccttcactctacacacttgtcccatttatatgttttatctcagtaggaaataacagatataagatgtgatgtaaatataatataaaagaaatattgcccttaattatttgtgtcccacttatttggaaactaaggttcaagaaagtaaataccaccccatctctttcactgctgtatccccagcacctacactggtctgtgaaatttagtaagcaataaatatttgtcatgtgaatgaacaaaagggagagagtataaattgggaaacatggaccacaaaatgaacaccactatagtactttctctctgtgcgatcattttctgtttatttgtctacaccttccactggacactgagatcaaggttgtcttcaacgttatttccccactagaacagtatctggccctgccatatgataggccctcaataaataaaaattgtcaaaaagcttgaaaatatagggctttttatttcattatcacctggaagttaatgtgggaagtaggtttgcatatcagagtatgtttcttcaaagacacgtttacaaaacagtcatagaagattgtaactgagagtaaatcagagcaaattaaggcaaataaaaaatacagcaaatcaactaaatatttccctgtgtttccagaattttgaggtatcctgaatttcttggataagaatgaaattgttatgaaagaatgaatgtatgaactaacttaaaaaaatcaaaactaattattaagtagatcctggccttttgttggtcggtaacattgcctaagccagtagagtttgtgttctgtgccattaaagaagagcctgttcattttatgttgttttcttccttagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtaagtacacccaggcaacacattgccctagctttcatgtacctaagcagatttcgttgccataagagctgtgattgaataagtaccaggaagatctttgcttttctgccacagtgtctgaagctctgcttactctaattactcttttaaataggaagctgtggcctctcaagtttctttggtagatgcagttttctcaagtgagttggtgtatcaaacagttcatggtaatttgtaccttagcatttagtttattagattggagcaaactaatatttagcaaaatcagggcactatgaaatttttgataaagaatttgtgaaaacagttggagtgtggcacattctctaagcagtgtgtttttggtgagggtgggggatggcagccaccatcacccataagatccctgaatactgaacgactgcctcacagtgaatggagagtgtctgaagaagtgcataggaacaagacaagatcaccttggtcttagatattcttattaaaatacccttttaatcttgaaatcttaacacttttttatgtacatatgcacatatatatgcataatatatatatatatatattatgcatatatatatatatatgtgacttaatcctaaatccggtatgttgtagctttgaggaccactgagcccctcttaatagctccacatgtagggggtggaaaaacactttgcaataataaagctcaaccaattcttggtataaggaagagaaaaagtagaattctaaataagaaaaaatagcctattcacaatcttttgaagacagtattacttaattatctcacaggttattatgaagataaaattagctagtagacatgaaaaatattgaaagttaaagtactatatcagcagtcattttaatagaattattgcttatgatcaattatatacttaataaatacttgttattgatgtatacaaatgtatttcacacataggcaatcacagacacataccccataccacattcagataaaggaggctagctatgtaaaacacacctaaacacacaaacgtacacaaacatgcaaacacaatacacacactaatatactatgtatttttgtaattctgtctttttattgaaattcaaaagactccctaatactgattattttatattataatgtattttatgcatatacaagtctatattcctataatcttctaaaaaggaacgatggcatctttcagaattatattatgattttttacattttactatcccttgcattaatttaaatcgtggactgccaggattaatttcagaaaattctacgtcattctttgtgatatgcaaagtaaccacgaagcaagccgtggtggctagcagatcattcttttcatgagctccctggcaagacaggacttatttaattttagcattacatgtatacccatccagccttgctaaatggacccaatgaatgtaatattaattagaaaaaactatcttgatccttttaaaaggatttttaaagggagaaataaactatgatcaaagaatgtccaaatgagcttactcaaagtatttgccttcttaagcttttggtaaatgttctctatgaccaactaaattataataagtgaaatgtaaaatatagttacttctacctggttttaatcttaaagatttgttagaccagaggccgggcgtggtagctcacgcctgtaatcccagcactttgggaggcggagacaggctgatcacaaggtcaggagatcaagaccattctggtgaaaccccatctctagtaaaaatacaagaattagccaggcgtggtggcgcatgcctgtagtctcagctacccgggaggctgcggcaggagaatcacttgaacccaggaggcggaagttgcagtgagccaagatcacgccactgcactccagcctgggttacagaacaagactctgactcaaaaaaaaaaaaaaaaaaaaattattagatcagcgtgtctaacctttgcattacaggttacttttctccttaattcacaaagaatattcctaagtcattcccatacgaatttattctagcttataaaaattctatatcttacttcaattttaatataaggttataaactgatatattatttatactaaaatattgtatacttatatcatcattttaaagcatgccatttctctagaggtcataatagattgatggttgtatgaactaatggcccatctgttgggcagtggttacttcatagtattttgcttgtcttctaggctcttccctagaagaattttaaaattcttagctcattatggaagagctaagaatttttaaaaatgcctcaaggggaaaatctccaagtgtcttgttcacttctttctggaacgtgttttctcaagttctctttcctgccagccctgaagtctaatttttgtctccttagctctttgagattgccagataattcgctggctttcctgactctcagcatctttcctcatcctggattttcagtctccctttcttctccaagtattaataggcggataccctgaagggaaaagtggtatgctgaatgtagcgctgatttcaataagcttctcttctttacaagattggcctgtcaatgttggctgcctcaacagctttacagtgccttcaaacaaatggttttgtttggttgattttgctttaattttattttgtctgattattctagatggaattataaatcatgtacaagctatttcattatacatagttcagtattttaagatggattttatagatagtgtgcatgtctgcattttaaatagtaataccctggttaagtgttactgattaaatatagacaaagtccaaaattttaccaaatttatataatctagggttaaatttcttatggaaagcagtgaaaatactttaaatactggtgtttcctaagtgctgactttggtctacttttccccctgtacgttgttatctattcttatggcttgacattttctatatgataacccctgaagttgtgtctctagcctataaaacacttttctgagctccatacccatattatatattcaaatgtcttataaatatctttaccagagtgacacacagctatttcttttttttttattatactttaagttttagggtacatgtgcacaacgtgcaggttagttacatatgtatacatgtgccatgttggcgtgctgcacccattaactcgtcatttaaattaggtatatctcctaatgctatccctcccccctccccccaccccacaacaggccccggtgtgtgatgttccccttcctatgtccatgtgttctcattgttcaattcccacctatgagtaagaacatgtggtgtttggttttttgtccttgggatagtttgctgagaatgatggtttccagcttcatccatgtccctacaaaggacatgaactcatcattttttatggctgcatagtattccatggtgtatatgtaccacattttcttaatccagtctatcattgttggacatttgggttggttccaagtctttgctattgtgaatagtgccacagtaaacatacgtgtgcatgtgtctttatagcagcatgatttataatcctttgggtatatacccagtaatgggatcgctgggtcaaatggtatttctagttctagatccctgaggaatcatcacactgacttccacaatggttgaactagtttacagtcccaccaacagtgtaaaagtgttcctatttcttcacactatttcatatttagtatgtttaaaattgatatcctaaaatgctttgacccacattctctatgaaatgtccactatccacccacatacacaggttgtgaacccaagttactttctacttctttcaccttacactcaatattctataatcatgaattattttctaatctaactcctaaatgtttgttttcctaatccagtttctcatttcaaccatcatctcttatttcatctcttcagttcagcttctgtcttctttggtatgttgcgttgcctcctaacttgtgcccctatctataatttcttcattttataatctatccattaagttctgaaatatggaaatgattgtattactctgatgcttaaaacccaatggttgccttttgttaccttcaaggttgtagcttgataggtcatccatggtttcacactaaactgctgaaccagttttttaaaaatcattcttcccactctcctcccttgttttcctttgtaactgaattgcttgatgtttcccatgatctcttatttcttttttatttttttgagacggaatttcactcttgttgcccgggctggagtgcaatggcgtgatctcagctcactgcaacctccgcctcccaggttcaagtgattctcctgcctcagcctcctgagtagctgggattacaggcatatgccaccacacctggccaattttttgcatttttagtagggacggggtttctccacattggtcaggctggtctcgaactcctgacctctggtgatccgcccacctcggcctcccaaagcgctgggattacaggcgtgagccactgcgcccagccatgatctcttatttgtatacctttgaatatatcttttatatctcaaatccctttctttcatttgtctacctacaaagtccctgtttttcctcaaagcatcaacttaaatatcaacttagtaaagtatctgttttcagattaaaaccctacctcttatatatagccttggtagactcacaacccttcataaatcctaagattgtactaattatactatattgaaaatatttgtttatgccagccatgtaacttgaaattcagcctggagaacagtgattacttacagactctatggaaagggttggtaagtttatcccttagtggaaatatctaaactagaaaaaggaaggccttaacaatgcaccgttcacaatagggttcatactcctattataatctaatgcctccactgatctgacaggaggcagaccttaagcggtaatgctggctctcccaccgctcacctcctgctgtgcggccctattcctagtaggccatgggcaggtaccagtccacggccctgggtttggagacccctaaaggatatatttatcgcttttgaaattagtgctagaaatgcttccaacttcttttctatcttataattggacggtgcttaaactaaaacaaaggcaaaagtaaatgaaatctgcccctgagtgattgctattggttacccgaagtaactctattgagagtacctggaagtagtctctattgagtagttttatattgaatgtctttggaagtagtcacctagttttcttgggacagattcttggctactttaggtaaagaaaacaagctaaaggagaccttatcatgcaaagtgtagggaggggaaaagagaatataaaaagagtcaagacccagggtggaagtaaagggaatgtggtcctgaggaatgttcatacatagagaatatgccttttatctggaaccccagttatgtgaatattgatagagtgattggagtgagtgtcaaagacatgccatacagaggtgagaggacaatgaagacattactttgatctcaatattctaacttctaagcaaccccaacacattaataaatgtcaataacagtaaaaatgacacaataaagatgataggttgttttgtacttctaaaatgcctgctttgtttcatccttactaattcatatgaattcaagcttaagaaaaatcaacaaataacttattgaataatgactatatacaaaggcttaagtgaattctcttatgcctaagcttagaatttgattgtaatgaaaaaattgcgtaacttcataacttaattttaaaattgattactgttttttagtttttttgttttttgtctttaatttgtagagacaaggtcttgctgtgttggccaggctagtctcaaactcctgagctcatgcaattttcccacctcccaaagtgctaggattacaggcatgagccatcatgtccagcctagttttttagtatttcagttttttagtatttcagcattatgttttactttagatacactaaacaaatctttattataacctactctgattatcctgcttctgaactaaattaccagttttgctaaatcctctgaaaataatctaattttgcaagctatattagaagaaatgttattaatatagaggacaaatctctattctaaattagaactaagtagaagtaattgtactctatgggaaatatgatatcatatgagagtctttattttcattaaattactttaaaagagaatcatgaaaaaaaagtttgttagagagcacatttacttattgtctgaggagtgaacaaagtcaccatacatctttgaaaaggaatgttgtcaggatctcttcatgcatttgctcaggtagggatatattactgcctgtgggtgcacatgcacacgcatacagaaacacaagtacatccacataaaaatagcaaccttagactagcattttctatctattcagaccttaaaattaaaaaatcttgaaagtacgcttccccacgaagtcttcttaggttaatggaatctaagagttagatgtctagcttgctttaataaagtttcccacacatccttaaaacatgattcaaattcttattcaaaggcctgttaactccttcaaatttttattctaaacatgctcagtatatctgactttttatggcgattaattatacaatttgttctgctaataccttgttctcttagtttgatttttacattattatcactccaaaccacaaccttagcttttctgattactgctttgtctctctgagaaaaatccaactaatgttttgagttatatctctcttggcttcccttagttcctggatccgctttgcacagaaggtggaacctaggtgtaaaaagaactttatcaagcttttcatccaatctccgtgtagttcttgagtaaccttcacagcattgctgacaaacattctttcactttatgtttgaactcttccgtgagaaagaacacactttctcccaagacttctttgtgtagaataggaagctatctcttttagattctggtttaatttctaattgctgggttcattgcaagcaagcaaaataatgtgatattttccacatgatactcctttaaatatttctcccagttcttttttccaagctaaacatttctgattggtttatatagtttttcatgcaacatctcttcactattttgatagatctcttctaaacttgttttatgtcaattctttttacttttaagaattttaaacttatagaaaaattgcaaaaattatagagtttacatataccttttatccagtgtgcatacatacttacataattatagcacaatgatcataactaggaaattaacaatgataaaaccctttaaactgcaaaccttgttcaaatttcaccagttttcccccaatgtcttttttctactctgaaatccaatgcactatgtcccattatctttagtgcttgtgtgtccttggtcttcaatctgacaatttctctgtctttccttggttttcacttttttttttttttttttttttttgacggaggcttgctctgtcgcccaggctggagtgcagtggcgtgatcctggttcactgcaacctcctcctcccaggttcaagtgattctcctgcctcagcctcccgagtagcttggactataggtacgcaccaccatgcacagctagtttttgtgttattagtagagacggggtttcaccatattggccaggctggtctcgaactcctgatcttgtgatccacccacctcagcctcccaaagtgctggcattacaggcgtgagccaccatgctgtgccggttttcacttttgaagagtactggtcagttattttatagaataactccaaacttgtctaatgtttttttcaagattagatggaatttacacatttttggctagaatgacacagagtgttaaagtacaagttttttcatatgaacatatgttttcaattctcttgagtatatgtctaggagtagaatttgttgggtcatatgatttaacttgctggtttcaagtatctcgttgtctttggctttcaacagtttatatatctaggtgtgggtctctcggagtggagtctgtgaaacttcttggatgtgtggattaatgtttttaatcagtttggggagttttcagccattgttttatcaaatatcctttctcctcctctcctctgagtcttttattatgcatatattggtacatttgatgctgttccacaaaaatctaaggctatgttaatttttttggttctatttttttttctgttcctcagacatggtaaccacaattgacctgtcttcacatttaccaattttttttttttcttcctggttatacctattgtttggcatcattagtgaaatcttcattttgggtattgtacttttcttttctttttttttttttggagacagagtttcgctcttgtcatccaggctggactggagtgcaatgacatggtcttggctcactacaacctctgcctcccaggtttgagcaattctcctgcctccgcctcccaagtagctgggattacaggcacccaccatgacacccagctaatttttatatttttagtagagatggggtttcaccatgttggccaggctggtctcgaactcctgacctcaggtgatctgcccatctctgcctcccaaagtgctgggattacaggcatgagctgccatgcccggcctagttattgtacttttcaattcaagaatttctatgtggttcttttttatgatttctatctctttattgatattttctatttgatgtcattctcatatgctcatttagttatatagacatagtttcttttatgttttgaacataattaaaatagctaatttaaagtatttgttcagtaaatctaacatctgggttgcctgagggatagtttctattcattattttcttgtgtatacatcatatcttcttggttttttgcatattttgtaaatttttgttgaaaattggacattctatgtggaaattttagaaatcataaatttttctctcaggatttgttgtttctgttcacagtagtagttgctatttattgacttttctgaatttacagatttaatttcgtatatctatattctttgtcacacgtggccactgacatctctgtttcattaatttagtggtcagctaatgattgaacagagatttccttaaatgcctgtaatgaagaaatctcctagtctttgccagaaggctctatgtgcatgttggggcatgacttcaacactctaccaggaagttagtaactgccttaaccttcacattatatataccctcaaagtcaaccagtggtaagagagtctagggccttctcaggtctttcctgaacatgagcaaagcctcaagcatgcacatggcattttaaattcccaggaatgtattggagctttccaaagcttatgtgtatatctcatgctccagcttttcttttaagcttttgaggttttttgctccattgttgttatccactggctcagatagccatgatgttaaatcacttgcttttagttgtttttaacaagtaacttcctgtctccttaccctatacccaaggaatagattttttgcattggctgaactctgagatacgtgaaatacagaaagccttgcaagttgggattttctttgggactgaagctttgaaagagctccagcttcattttgctccccaaacctcctcccctatgggtgccagagtgtacccagaatgagggctatttttccaggctatatgagtctagagagtctccccagccatgccttctgtacagcctgtggaactgtgagttaattaaacctattttcttcataaattacccagccacaggtagttttttataggagtgcgagaatggactaatatagaaaattggtacctggagtggggcattgttatgaagatacctgaaaaggtggaagcaactttgaaatggggtaacaggcagagattggaacagtttggagggctcagaagacatgaagatgagggaaagtttgtaactttctagagacttgttaaattattgtgaccaaagtgctgatagtgatatagacaatgaagtccaggctgaggtggcctcagatggagatgaggaacttactgagaactggagtaaaggtcactcttgctaacctttggcaaagagactggtggcattgtgcccccgctctagggctctctggaactttgaaattgagagagatgatttagggtaccttgcagaagagaaatttttaagcagcagaatgttcaagatgtgacctggctgcttctaaaagcctatgctcatttgcataaagaaatgacctgaaatatttaaaagggaagcaaagcataaaagtttggaaaatttgcagcctggctatgaggtagaaaagaaaaacccattttcagggtagaaattcaagccaactgcagaaaattgcataagtaaagaggagctgagtcttaatagctaagacaatggggaaaatgcctcctaggcatttcagaaaacttcacagcagcctatcccattacaagcccagaggcctgggagggaaaaatggttttgtgggccaggctcagagccccactgctctgtgcaacctcaggacatgataccctgcatcccagcccttccagctccagctgtggcaaaaagggccgcagatatgtctcaggccaccgctccagggggtgcaagccataagaatccttggcaacttccacgtggtattaagcctgtgggtgcacagagtacaagagttgaagcctgggagactccaactagatttcagaggatgtatggaaatgcctggatgtccagacagaagtctactgcaggggtaggaccctcatggagaacctttactagggcagtacagaggggaaatgtggggttggagtcccgacacagagtccctactgggacactgcctagtggagctgtgaggagagggccacagttctgcagaccccagaatggtagatccactgacagtttgcaccatgtgcctggaaaagcagcaggcactcaatgccagcccatgaaagcagctgtggaggctgtaccctgcagagcacagggtcagagctgaccaaggccttgggagcccacgcctagtgtcagtgtggcctggatgtgagacatagaatcaaaagagattattttggagctttaagatttaatgactgccctgctgggttttggatttccatggaacctgtagtccctttgttttggccaatttcttccttttggaatgggagcatttacccaatgcctgtacaaccattgtatcttggaagtaactaacttgttttttattttgcaggcttataggcagaagggacttggcttgactcagataagattttggacttgaacttttgagttaatgctgaaatgagttaatatttgggggctgttgagaagatatgattgtgttttgaaatgtgaggacatgagatttgggaggggacagtggtagtatgatatagtttggttatgtatccccactcaaatctcacgttgaattctgatcccgagtgttggaggtggggcctagcgggaggtgattggattatgggagtggtttctaatggtttagcaccatccccagagtgctgtcttgcgatagagttctcatgagatctggttgtttgcaagtatgtagcttcttcccctttgctctctctttttcctgttctggccattgaagacatgcctccttcctcttcaccttctgccatgattgtaagtttcctgaggcctccccagccatgtttcctttacagcctgcagaactataagtcaattaaacctcttttcttcataaattacctagtctcaggttgttctttatagcagtgtgagaatagactaacacaacttcatatctagaatacccaggtactgaaatacaaagacctaaaattacattttcacaaactcattgtactaaatatatcttaagatatgcctctaaaattatctttgattggagtacagtggaaagagcaggggctttggaggtagatagacaatgagtcaaataccaactcaggcatgttctagttgtgtgacactgagcaaattacttaccctctgtgagcttgaagttttccatctgtgcaatgggcatcataaaacctgtgtcctaggattgtgatgtggattaagcgagatgatgtgtctagggaaaatgcatgtacagtacctggcacagagcaggggacaataagtgagagccatatgtataagtctatgaatgtgtgtctcatatgaagtagtaattacatgtaaacaatcagacaagcccagttaaacattgttgaccctgtaagtcctgaagagttgcttaccattttgctatctccagctattttgaaagtattatttacatcatttccatccttttcttctgcactcatgtttgacataaagattgcaagcactaaattctttaatatttctgaaactcagaagcttctaccaacctgagttaggagcttgttttattttcatcataaatgagaaagaaaaatgtctctaaagcttacagtcttctatgagactgtcttggtcggtgagtgctgctgtactagaataccatagactgggtgacttaaaaagtaagcattatttttttttacacacaatcacaacaaaaatgggatatcatgtgcactttccaatttactttttatttactgaaaagtaaataaaaagtttgctttttatcagtatgtaataccctgtatcggtatgtaatactcattttctgtgtcagtatgtaatacccattacattataatttgtaatgttctattgtgttgatttaatcaacctttttgacagacttctgaactatttctagttcttctttttatcattgttgtgatgaatatccatatataggtatctttgtacacttatgttaatatttttatagggaaaatttcaagcagtggaatgactcaatgatatatgtataattttttactttaaaagatattgtcaaagtgttttcttaaaaagatgcacgtgtttacactaaagcaacaaataatggcagtgcctgtttcccaacattcttgccaactctgggaattataagtttttaatgtttgccagtgtgatttgcacacacctaaatatacacatatatagtaccttaaacttgtatttctttaattattagttatgttttaatagcttcatttatcatgtaccagacactctactaagtgcatactctcattaattcttatacaaccctgtgagtttgaatatctttgcatagatttatacagcatttgtttcttttttggattacttgttcatctccctacattaatttttctgattgcttgctcatgtttttcaatgatttagagagtgtgctttgttcttgctcttttcttgtttccttcttttcttttggaggtgaggtgggctatattatagctattagcttttgtctctcctgaatttttatttctctattaacacatctttctcctatctatttttaaggaaatttacatcttaatatgagatgagtttttgtatgatatcaaattgtttcagataattattttaaatattttgtgtgctaattcaattttccatctacaataatagtacagttaacatgttgagaacatttaaagttatgtttaactttaactcagggttaaaacggtgaaaacatatgttgccataagagtctcagtctatattcatcctaatttattaactagatgcagaatcaggaagattaatgattactttttaatgcaaagtgctaagaatttaggcatttgaaatatcaagcggaatagagcattaggaaataggtaattgtaaaattgcgggtggcagagttgtaatgatagagatattcatgagatcacatttcatcttttttattcccattacaaattttagtgataaaatggaaaattgggcaccttttgttgtcagaagctctataatgcaaagtttttttcagtatttcaaagatttccagttggaaaactgaaaaagctcgtacaaccacagatggtcaagtgtgtattattcaggaaagaaaacagttctttatagaggaagttctgttgtagatgtctctaatgaaaaagggaatacctgcaaatgtaagcatcttgtcaaacaggatacttcatacaatttaagaaaaaccattcctggctcaaaaggattttctgacaattgatttgaggtttgtattatttactttgtagcttctcagaagcaaggatctgcctactctttctttttctgaaaataatgttatatttttcttataaaattaatcaatatttattttagaaattatggaaagcaaaaatatacaataaaaataaaaatcagaggtatcctcatcattcagatataaacacttgatgtgtttctgtttatgtctagatttatacatttttgttttataatagaaaattgagatctctcaattttatctcctgcttatttcactcaatgttatattattagaatttcccatgcattgagtatacctcagcattttttaatggattcacaatgtctgtctcatgatagatttatcaaacatgtttacctttcctcagcattgaatgttaaaattctctccatccccatttttaatatttaaaaatctgcagtgaatgtgctatgttgtatttctacttcacagatcccttgaaatgaaattactagattaaggatataagatttttagaaatattggaattatgaaactgtcttccagaaaggttgaaaatttacaatcgtaacattttttgaaggtaccagtctcccaacgcaagagctagttagtcttaattgttttattagcagtatgattttgatagtaaatattgtatattaggttgatgcaaaagtaattgtggtttttgccattacttttggtgactctccagagaaacagagcttacaggatctgtgtgtgtgtgtgtgtgtgtgtgtgtgtgtgtgtgtgtgtttatagacatttattataaggaatggctcacactgtcatggaggccagctcaagatctgtagggtgagttggcaagctggaaaaccaggagggctgatgtttcaatttgagtacaagggcaggaaaaaaaaatgatgtcccagtttgaaggctattgggcaggaagaattctctgttactcggggaaggatcagccttttttcctcaggccttcaactaattggataaggcccacccacagtagggagagcaatctgcttcactcagtccaccaattttaatgttaatctcatctaaaaccattcttacaaaaaacacccagaataatgtttgaccaaatatctgtcaagttaggttctcctttgtgtttccatttttcttttatttttgagacagggtctcatgttgcccaggctggagtgcagtggtgcagtaatggctcactacagcctcaacttcctggactcaagtgatcctcctgcctcagcttccctagtagctgggactacaggcatgtaccaccacacctggctaatatttttatcttttgtggagaccaggtctcactatgttacccaggctggtcttgtactgctgacctggaggaatcctcccaccatgacctcccaaagtgctgagattataggcatgagacactgcacctggccatttttcattttttaagaagtctgcagtgaaagtattatgtcatatttcaagttgacacatgaaattaaccatcacatgtcataatatgttattgtttttgttgctatttttttaatgagaccagggagtttaggcatactcttatttattcattggccattttgtacttacaaactgtttgtattttttgtccattttcttgttttgttattgatttgtgagaactttgttcctattaaagctattactttgtagtattcgatgaaaatatttgccacgctttgtgatttatgtttttaaattgcagtaaaatctatccaactttttgtatatttttattgcatgtttcagaacatttttcttcaattacatctttcaataccattttattccatttcattttggagggttctttttttcctgaatatcaattaacttatttggtctttctatctcacacatttgcattatattttctctaattcttttctctttgtgtctttttctctcagttgttgctaattcaattgcaagctgtgtttatttcctatgacactaaatattgtaacattatttttgcttgatattattcacatcagaactcagaaaatatgatattgttttttctagcattttgtgttaaagagattagcctgatatttttccatttagttaaattttttcttcaccttcatgaatgcttatagatcttaatatttttatttctataatgtaaaactttgagctgagtatatataattgtagctattttttcttaaacttgtctggtcttgggtgggctcctaagtccacagacgcggtgtgttctgctcaatgaaatttttcaatcttacacagtctatttgctattttttcattgttctggaatcagagacgtcaaagtattgtgagtactttgtctttcatgttcataataatcgtgttttttaaaaacagtttgcagctctttgactttatcccatgcatctgtcacagcttctccagcttgtctgctatgaaagtgattttggattctgcagtgtcattttgcttattactgcttccaatgcgaatgtcaggtgttatttcattttcccccatttcttttcctcttttgttaaatccctcagacaacctttatttgggccttattttgcttcttttcctttgggtttgtcttcttggatcctatttagacttccaagccattttctaaattttttctggcccctttaataattttcaaaattattatcttttttttctgaatttgagggctttcactttttcttctcatgtacccatgttgatattttttgttaaatttatttactcattctagaatgagatccccatggggcctcatgttgtccaatacatgaagttatgactttggttctgttcactttcttcttagaatctccattttcaaatatagagcctaattttaaatgtatgtacattataatagcccaattaacagtgattagtaagtattcatttactacagatctgtaagatggatgtggtagttacctactgttacctacatagcctagttatctgatactttaaaaaccaatgaaatatatggaaaatgtcagccccccagtagactctactcctgaggtttttcttgtctctgtacctgtgtaatagatctttccttacctcccagggtaccacactctaacacagtccctttacttcagctactcatgtggaattggtgagctgcagcctctaaacagtatataaaggtaattaggactggttgaagggatggactgctagcataagaaaaggtggtactcagtcccaaaaagaaattatttgagctgcccagctttttagtggatagaaatcctgcgccttttaattgagtgaataccaggtaaaccattaggtaacttgtttcttcttgggaaattaaggtgtaatgaggtacagggacagaataattataggtagcacagctagaattaaaccacatgtatctgacttatccacagatccatagctgctctgaaacatacgctagaaatcctattctgcttaaaacacagtcactggtgatattttatatgactatctgacagtttctctgaaggtagaggaagcagtgaggcaaactacttgacataattctgttcagttctagaaatagaaatgacgagatcccaggagaaaacatctcgccttgtggagcccttgataaacagggagggaaatcctgaacgtaattaaatgtgtgtacacactaaaatttaggaagatccatttttaaacactcagacaaaaattggatatttcatgaacagaggtactgaaaggaaagagtgccagaggaataaaagtttcaaaagttaagttcaaatggaatggttgggaataattttaaagaaaaatatttacagtcatcaaaatcagtatgggtacatgtattcttcccggtggactcagatgtaagaaggacatgtataatgaaagaaagtaggaaagtatcattaatgggaaaagaatagccaatgtaagaaaaagggaagcttaaatctaaaatgaagtgaggcttgctaaaaaatgatgaaatggtaactgtaggaaaagagaggccatttaaagtatacattcagattaaacatgcactcaacactggagaaaatgtcgactataaggagatgttacagtattagaaaaaggaaagaagcttaagtcctattttgcttcaatcttctctgtcaaatagaatatttggggatgggggaaggctacctgtaaaagacttccaactatcagataagtgaactgatgaaaaagcatctaggtgttctaagtaacattgtgttttcttcctgcatgaatgataatattcaaatatgagagaacctgatgaactgactttgaggaatgtagcatgcaggacagtttcgtaatggaaaacaaatgaaaagcaaatatttttataaatctaatttataaatctcaaccatcttatgaatcctcaaaatctaatttatcggctttataaattagattctgaatcctcccggtcctaaaaaaaaaaaaatttcgtaaaatatcttattcatctgatttttggggaacgcttagggaaagaaagtggtgataaactagaagattatgtatactattagaccaacttcctttgcaaggtgtataccaacataggagaatgctatagacattgtaatctttcactttgactcctgactttcttaaggatgaaatggtgaaatatagactggatatagttgagttgttttgtgattgctttaataaatgtacctaagtattgatttaatcatttgttgtgaattctaaagctaaagagaaatgctggaaaacactggggcttcagggggagaatggccatgatggttaggaggatgtcatatgccatcatggagagggtcacagatagaagcgagggggagggctcaagtgtgagaagtcctaggggagagagcatggctttcttcaaatgaataactgacatagccaaaaaggaggcctggagaatcgactgggagaggcaagcattgaatggaagttaactgaatgaactctgaagttcttccctcaatgttttataattttgttctcttttataaacctaaagtacagacatattttttaaattgttgttaaatgcaccacattcaaccctacactaaatttaagtggatattttgtatattttctcagaattcatcttaaactttatagcttctttatgctggtttcagagtaaatgctcaaaaaactatttggttggctgatttaagtttcttgttgctaaaatatcacctaagatatggcttgtaaaccaaaattaccttctcttaacagaaaaagacaacgtaagatacttatgtaaagaaatttaacagaattttaaaattatatcttaaaattgtatcataactttgtaaggcaacaaatccaatttgtttgctattgctgtgtatatatatatatatttttttgaagtgcagtggcgcaatcttggctcactgcaacctcgcctcctggattcaagcaattcttctgcctctgcctcccgagtagctgggactacaggcacacgccaccatgcccggctaatttcttttttgtattttagtagagacaggatttcactgtgttgcccaggctggtctattgctatttatgttgtgaaaaatctgcttatgctgcactctcctactttattatccacagtcttgttcctctaggtgctcaagctagatcatttggagtcatctttggcagcactctctcaccaatttctgtatcctgttagtcacagggttattgatcctttcgataacacttaaaacctgttctctcctgtccattcttatttcacaggcctaattcaaatcctcatgatcttgagcaaagtctattgcaatagcctcaaaaccagttatatcatttacccccattccaatgctttgcctctaccatcgctatagttcattccaaaacacagatctgcttaaaacccttcaggaatttttaaatccctggggaaaaaaaatccagactcttctacacagtatgcaatgtccttaattcattggccccaaccttcattttcccagcctttcatagccactcatgcctgctaagccctgagtctgtatttttcaaactagaatacttgtagagtggccagagtcacagagccacaggatagacatcgcccatgttcctggaagtttaattttatttaaatatctaggattttttaaagtagctcagctggtaaataagttaaaatgccatttttatactacacaagttataccctgtgacgtctgaaggggaatacaggtacagagccttacaggggcagatgcaggtttcaaggagactgacatgtctgtgatttggaaagccaaccataagaaatatgtacaaaattgcaaatccaaaattagatacaaaaatgaatatttgtaaagagaaaaaagtcacaacatattgtgtacttaaaattttgacaaacaccacaaacatacaaaatccagaaataaagtaactttattattagttgtcagacatacctctctaatttttttcacaaaatttttgtatactttttgatcacctctctgcatggtatcaattagtaagatgttctatggagaaacctgaatgatagataagtacttcctctaacacggtcaattgaaatctgttcctatactcatagatgttctcactgttcatagtattgctacagattattcacaacaaagacagaatcctcataaattctacttcatgtgattttttaaattaaaaataagtatattaagcatttataatttaatatactagatatctttctgataaaaagagaaatacgggtatgataattggaagcatttttcatagatcagcttctgtatctgttcttctgtatctggacccagttggacattttcatatctttgtataacctctgaccctgcatgtccctgtcactgttgccacaggaggtggtacagtgggtgattgccaacaatgacttcatgataagtggaagtgcctgcaagccacatgaatatttcccacacactccagcaaaattaaatctcatctgaacttccccttaaccacatcccaaattaccagtcattccaatatacccaatgcaagagcggttatgccagaaggaaagttgggattgaaaagacagtggccttaactaatcgtaattaaaatatcttagttttacaaacttaacaaaaaatcttcaccagttgaacatattgctggggccactcctgaccctggaaggggccatgcaagtgagtggccctgacacttaaacttcattagcttcatggtacatctacctctggttcattacaagaaagaccacactttactggctcctgataattaatacaaaatgttttttaacatatactcatagtgtagccttcagtgcttagactcattccattcttttcctcctttgatctccctacctacttccttttctctcccctgggtcctactccatcctgctactgcctcttgtggtcacggtcaaagatgcccatttctgtctccattttgaaaggttactggtgaatccttatatcctcagaacagagcatatataagaaatacaaatgtttttcttgataatattgatttttctctcatagctttaagtattagtattttgatgtactgaaagacttccccctaccttgcagagaggttgagatggaaaagagaacagagccgtatcgcaagtgaaaatacataagaaagataatgggaaattccagtgcatttttaggatgaaacagaagaaatcaaagaaactccatcttagcagtgggccttttaaagctgcaacttcagatcaccagaattacccattcgttctttgccacttttctaagtggaaaaatctgagaaacactgctgtgtacatattcaattatactactaatagtattatttcctattttgccctttgcttttttttagaagagcatttcccatctctgccaaatgattttttactcaactttcaaggtctagttcaaaggttattattctatgttattctatgacacgtcctcaggacacttaaagcaaaattaattgtgtctctttcttcttttctaatggctttaacccctattttatcatttagaagatatcttacagtcaaatatttatctctcataaataaatattaggtcataatatttataaaggcgatgtctcattcttttttgtaatccaggaacctatcctgacagtgttgtgctggtaaatgtttaacagctgacttccgtggtcaggagacaactgacttggagcatcagttaatttctgtgttttaaattctcccaacgtggtagcttccaaactaccaatggagaatcactgaccacagaattggaaagagatgcatacggcacactattctggggcatttctaccagatagatatagtagatgcatgaataataataaaatgtagcaaaataattaagaagtcatgagttttcagtatttattacctttgcttttaatctacttaattgtaagtctatataattttatttatttttttatttatttgagacagagtctcgctctgtcacccaggctggagtgcagtggcatgatatcaactcactgcaacctccacctcccaggttcaagtgattcttgtgcctcagcctcccaagtagctgaggttacaggcaggtgccaccatgcccggctaatttttgtgtttttagtagagagggggtctaaccatgttgaggcgggtcacaaactcctgacctcaagatatccttccgtctcggtcactgaaagtgctgggattacaagtgttagccaccatgtctggcctgtataattttacataatggttgtgtttaataactggttcaccaaattcttgaaaatttaaccatcagttctcatagagctagtacaaaccagccccagcacagtattttacatggctccttgaaagtgaatattgacaaatcacaacagacattttcagaggattctagaaaaaattcatatttgtagtggaggaggaacactaattctgacccttaaattgatactgatgttatcctcagataatctgttgcatttatatgcagcttgctatctcttcaattcataaaaattctcaaaatgtgttgttcatagaagtaaatcacagagtaacacaaaaactgttgatcattccctgagttctttcaagcttgacattttcctttgtatagatatgaggtcaaagggagcaactatgactttccactcacagaatctgggcaaaatgatctttcatcaaggcagatgataaagagaatagatgtgacatcaagaattgttgggatttcctcggataaaaactcttatagactcattattgcaattctgccacaggtctcagattgtacttactggtcctgttggagacaattgaaacaagacaaggcaaataatacagctctagtgtgttccaagaataacagaatgacttactgttatccgtcccatgagatgaaattagatatttctgagagatttcagaataaattttattttttattctaaatgttcatacctgtaatctttgctctatcatatagtaaatatctgtctataacagacatttagaaccagataatgaaaaataattggaaattttcttttctaaaagctataacttttgaatatgattttaataaaagaattccatgtaagttttttttctattttgcagtagctaaagagaaattaattagtcatgtcatgaaccaaagttatataatatgtgtttataaaatagtactaattcaccacactaaattgactggatttcaaaacattctatcacagcccttcaggtatttagagtcaaggagaaagagagactaaaagcatcggaaaattaaggacatacaattaaatatgtttcaataaattaaggatagttgtataaattataagtacaaatttcatgtgtttcttaaaacatcacaagttgctttaatttttgagttccattaaggcattacagagcaaaaaaaaaaatgttgacttgatcagggttactctggtaattactcttatcatcttagcatttcattcgtaagaattggcctatggtagattacaaacataatagtctttaaacatgaattactaaaaactggccgggttaggaagtctgtgttaataggggaacaaaatgaatggggatgcataaaagctaactacaacatgacacacaggcttccttagaaataaataatgagctaattcaccatttctgagaagcagtagtttcatacgcagttcctggggtggatcaaaagaatcacctaaatatgagcacacatctatccatcttctaaaagaaaaggaaatgctcaactatacacaaaggctatgttaaaacaccaggcttgttctcagaaatcagatgatcttggagggacttttcattgacttttgtttggcctgtgcaggcatatttatgaattgtaagagaagctgaaatatttgaaatagagatatcaagttctcatttatttagatgaatttttagtggaccaaaaatgaaatgaaaggttttaggccaaagatattttcatatattaaacccaccaggaaatgagtactttaaatgacagtcaccccataatacaaagaaattttgtctgatttatctgaaatgctaaatcatgtactacttacagtggaaaccttctgtaaattttctataagttaatcaaatttgcatcctaagaatcacttttcattcatttaaactgtattgatcttaatctctgaaaatattctgaaatttttgaaatttatttaataattattagacaaagtaatattttcttagtgctgtgtgctgtattgtaataattgatttacctttctttcccactaaactataagttccctgaaaatagaatttcaatatcatttgactttggattttcagcatagtgcacttaaactcactatttgatgagtgaatgatttcttagagaaagatattgaattcaatttatgttacaattgttaatatgcataaaaaatatggaacaatatacgtcaatctactagcagtagttttctctaggaaatgggatggggaaggggtatcaggagtattttactttctgctttagatttgtatgattgtcttcatcacaaccttgctttactactttcataataaaaatgttgaggacataaaaaagtagcaccttaaagttagtagatgaaaaacttggcaactatccaacttcttgttaatgtttatggtaaagtcttcactaaattgtattaccagttattttattttctgaggaagaaaaattggatttgaatacttttatagtcaagaacatattatttctagttcttttctgatgttttggatttgtcttctcttcacagttgtgtgtctgtttctctttcttccagagttatcagtttccttatttagtcatcttcaccctaataagtggcaaacaagcactactgcctagattctagggaatttcactccacattttacctcatctatttagaacattatgatgttcagaatacttttgtagacactctatatgtattaacatattaatacattgtgtatatatccaacatctctaatctataaaactagaaaatggtgaatttaaatttctgtgttctttctctaactagtatcatcattatcaagttatatgtttacgacattgccggtattttccattcacaaaggcttttcccatttagatttgataaggccaggggggaaaaaaaaaagcaatgctaacagaaatggtttcgtggttaataaagctactttattagcttggaattgcatttcatggatagtagtagcaattaaccaatttatccatttacaccaaaacacttctccctgggaaatgagctacaatctccttcaatactgaaaattcccccaggtatctgagcacttcattccccacccctctcttcacggccaataaaattaccctttctttttgattaaccattatagtgtatctcacatttaacctttccttttcattcccactattactgcttaaatccaggacctgaaatacaaacgacttcaatagcttgctaaccgtgttcagtttttctttacactggggctaagttgttctaccttcctctattgccaattcacctggtagctggtttcctacttacttctaaacaaaatttgatttcccttaaaccagtgttcaaggtccctggatacctttcagcttggtctacaactgttagacattccgtttattccagtctggttggaatacttgttattattccccattgaacaacttacgctttcctttctccgcccattttcttataccatttatattaataagttgccttcagttctcctttataatctattaaaatcatattctttagacctttaaattatttagggttccatgaccttctagaagccttgctttatttccattatagctgggttctttcccctatgaatagctatttatttgaaccatcttatgacacttaccacatattttcttgtatcatcatttatgtagctctcctcccattactttctttatttcctatgtgtcaagtaatgtgctcaatgctgagggaaaagtggaaaacaaaaagcagttttctccctcttgagacagggtccatggtaatgtatattcataaatgtttaaaatacataattatatatatgtttttaattcctttttaaacttttattttaggttcaggggtacatgtgaaggtttgttatacaagtaaatttgtgtcatgaggggttgttttacatattatttcaagtattaagcctattacttgatagttatttttttctgttcctctccctcctcccacctccaccttcaagtagacaccaatgtctgttgttcccttctttgtgctcatgagttctcatcatttagctccaatttataggtgagaatatgcagtatttggttttctcttcttgcgttagtttgctaaggatgatagcttccagctccatccttgttcccacaagaaaaacacatgatcttgttcttttttatggctatatagtattccatggtgtatatgtatcacattttctttatccaatctgtcattgatggcatttaggttgattccatgtctttgccattgtgaacagtgctgcaatgaacattcacatgcatgtgtctttatgatagaatgatttctattcctatggatatcatacccagttgaatgatagatctgcttttagctctttgaggaatcaccatactgctttccacaatggttggactaatttacattagcaccaacagtgtataattgtccccttttcttggcaaccctgacagcatctgttattttttgcctttttaataatacctgttctgactggtgtaagatggtatctcattgtggttttgatttgcatttctctaatgatcagtgatactgagctttcttcatatgcctgttggccacatgtatgtcttcttttgaaaagtgtatgttcatgtcctttgcccattttttagtggggttgtttgctttcctcttgtaaatttaagttcctcatagatactgagtattagacctttgtcagatgcataatttgaatttttttctcccattctataggttgtctgttttctctgttgatagtttcttttgctgtgcagaagctcttaagtttcattagatcacatttgtcaatttttgcttttgttgagattgctgttgttgtctttgtcatgtaatctttgctatttctatgtgtagggtggtattgcctaggtggttttccagggattttatagttttgggttttacattaagtttttaattcatcttgaattgatttttgtgtatggtgtaaggaagcagtccagcttcaatcttctgcgtatggctagacatttatcccagcaccatttattgaatagggagtcttttcccaatggtatgttttggtcagcttagttaaagatcagatgatcctaggtatgtggccttatttctgggctctctattttgttccgttggtctatgtgtctgtttttataccagtaccatgctgttttgcttactgtagcctcataggcaatcccattcacaattgccacacacacacacacacacacacacacacacacacacacccctagacatacagctaaccagggaggtgaaagaactcccggggctgaagcctacttgatcatggtggattggctttttgatgtgctgttgaatatggtttgtaagtattttattgaggatttttgcatcgatgtttatcaaggatactgtgctgaagtttttcttttgttgtttctctgccaggttttggtatcaggatgatgctggcctcatagcatgagttggagaggagtccttcctcctcaatttttttgaatagtttcaatagaaatagtaccagctcttctttgtacatctggtagaatttggctgtaaatccatcaggtcctgggagtttttttgttttttgtttttttttggttggtaggctatttattactgactcaattttggagcttgttattggtctgttcagggaatttatttcatcctgattcagtcttgggaaagtatatgtgtccaggaatttatccatctcttctaggttttccagtttgtatgcaaaggtgtgtttgtagtagtttctgatggtaatttttatttctgtgaggggcagtggtaacatcccctttgtcatttctaattgtgtttatttggatcttttttcttctttattaatctaactagcggcctatatatcttattaattttttcaaaaaaccaactccatctttcgaatggtttttttgtgtcttgatatctttcagttcagctgggattttggttgtttcttgtcttctgctagctttggggttcctttgttcttgcttctctaatatttgagtcgtgatgtttgactattaatttgagatctatctaactttttgatgtgggcatttagtgctatgaatttccctcttaacactaccttacctgtgtctcagagtttctggcattttgtatctttgttctcgttagttttgaagaacttcttgatttctctgttaatttcatttttttacccaaaaatcatttaggagcatattgtttaatctgcatgtaattgcatggttttgagcaattgtcttagtcttgacttctgtttttactgcactgtggtttgagagtgtgtttggtatgattgtggttcttttgcatttactgatgattgttttatgtccaattatgtggtagattttaaagtatgtgccatgtggcgatgagaagaatgtatattttgttgtttttgggtggagagttctgtagaggtctagcaaatccatttggtccaactttgagttcaggtcccgaatatctttgttaattttctgcctcaatggtctatctaatactgtcagtggaatgttgaagtctcccattattgttgtgcgggagtctatgtctctttgtaggtttctaagaacttgtcttatgaacctaggtgctcctgtgttgggtgcatatatatttaggatagttaggtcctttaggtgaattaaaccctttaccaatatttaatgcccttatttgtgttttttagtctttgtttgtttaaagtctgttttgtctgaaattagaatcgcaacttctgcttttttctgttttccatttgcttggtagattttcttccatctctctattttgagccaatgggtgtcattatgtgtgagatgacagcgtacaattggggcttgcttttttatctggtttgccactgtgccttttaaatggggcatttagcttgtttacattcaaggttattattgatatgtttggatttggtcctgtcattgtggtgttagctggttattatgctggcttgttcgtgaagttgctttatagtgtcactgatctgtgtatttaagtgtgttttgtattagctggtaacagtctttctctatttagtgctcctttcaagatctcttgtaaggcaggtctgatggtaatgaactccctcaacatttgcttatttgaaaaagatcttatttctcctttatgtaggaagcttaatttggctggatgtgaaattttagttgaagatttttatattttttaaattattaatcagcctttaattggctaatttggaccatgccatgccttaacaatgacaaacaatatcttgtgttttttaaggatttattcattatctggtttcaggtattgtgtggtaggaagttctttagaaattaccagaccctggagggtccttgttcttacacactctagcccccatcctagttctcagtccctgcaagcttcacacacatgtgaacaaatgcagagaaaaattacttgtgacccaggtcatttacctggtctctttttctgtcttaatttccttaagctgattattgattacaaagaaaacctctggactttggaggtaggggaaatgctggccaatatttcatgaaaaccattcactgtcctctgcatcattagtagaagaaacagacatgcaatcctataagcctaccaaaggtcagattgatgaattttaggtatcctgtggcaaatggtgaaaatcagagatgacgctcacctgctccagcttgaggatatagactaagttaaaatggaataaaagataatgtgaccaaagaaaagaaagtcatttagttcatttttttgttgttcatcaattcaataaatattttttaagcaccttctatgtgccaattgctctagtagacactagagatacagtaataaaagtagtccctgatattaatccttggtgttagtaaaaagagaaagtacagggatgaaaagggaagctaatgagggaacagagaaacagagaagagaactttaacattgatctagactgtaatatgattggaagacgtagggatattcaggatataaactgaagagttccaatgggagaaccgtttatgaaatcattgttccattgcactcagtagtaccaagcagtccacaagaattgacacacatttcaaacatgacttactacaagcatggctttcaaaatggatatatgtgactcatgaagagccttgttcaatctactattgctaaactttcaattttgacatatttttcattaagaggtgctgttctgtcttgcaatactgattgaccagccgccaaaccacatgaactacatttggaccacaattggcagaatgtattctaatgtgaaagataatacagcaagtacttctttgtaattccatgttcaaaatgaaagtataaaataagcaccaaaaaaaaaatgataaattttccatttaaaatgtaccagtggatctgtgggggtctatgaaatgtcttttgctttcctatctgaaggagagctcaagttgtttatattgtgctgttacttcagcagtgagtcaggaacactttatcctcccgtggcatgaatacagggggtgattgcaggcaaaacaaccagtcagagcaattattacatgctctttggaactctgtgctgtgcctcttggtaaataggattttatgataaaagcatcaagatgtagacatgtcaccagtgatgtgaattgttgttaagtagagttataaggtacaaatgtatgtatgcccttggatgtgaatttacccccaggacaatgttttccagtgtgtggtttccaggtgacttgtatcactagaaaatttcgatttctagtctcctacagagattcttatttctcaggtctagtgtgggccctgggtgtcagcactttgaacaagtcctcagaggattctaatgcagattgaggtttgaaagctatggacctagaagaaaaagaatcacttccaatcagtcaacataactaaattgttaacagaaaactataattttatatattcagcagtataaagtatatatgatattctgaaagaatgtaaaacaaatatattatattgagagtattcataatctaccctactatgtttttaacaagtacatgctggatcttctatattcacttagaaaaagaaaatgatatacagagacctaataaagaacctggttctgaaagggaaggaaataccttttctgaaagtctctgagcatcttttctctcttctgaccttgtctgttctgaaagatgaatgtcctacaggcaatcccagggggtcttcctagactgcaattctccctgcccttaaatatgtggagttaactgaagctccagacagctcagctccagatgaatttctcaaacagttccttctgctgtcccgggacctggccagagattccatgggagatgcctttggtaaactggatatgggagatttacatagcagcatagtgggagagaggttttggcagagcctcttcaagagaagtgttgaaagaaaagctgagatttatgttacacagtatcttgacctcaagtagtgtttgctttgggttcttaggtgtgaaaggcaacttttgcatttctaaaaagaagaaacttgtaggtcttgcataccatgtttgccctaagtcagctaaaggggaaaatgcaactggacattcatacaaataaattaagaaattaatcttaaatccttttgttaaatagtcacatttggattcctttatgaagctgtcttctaaagcagagttatactgattcaataaataaatatccctatatttgatgaagcaaacttaggattcatgctaatacaaatgacagaaatccagtgtaaactgccatggcttaagccttaaagcttaagtaagttggcgaatgactggcttcaatcattgctgaattcagaggttcaagatgtcacagcattctgactttcaccatctaggtgttgagccggtgttatagaaatcggtcatttcatcactgtaagatgcctccctcagggtggcaacataatggctggtggcttcaggttctcatcctttcagcctaccagtccagaagaaagatagtttctcttttcaacagttccaacagaagttctaaataggagtcctgttggctgcatggattcaatatccacgcctgaacttatcattgtggctaggagagcagataacattgattatccaggtcatatgcccatggctagagcaaaagcagggaagatgaggtcagttatgatgaaatcacatgaatttcaaaggaaattctaaactgctgttaccagaagaacagggaataaatgtactggcaactagcatctatgtctgttacacaggtacaccataattagtaagtagtaaggaaagtagcagtgggctttttgtgcattcacctttgtgattgttgtctcctttaatctggtatggatgatcattttagccagaacacctttaaccactttttcttaccttaagacttatactatttgatgagtctgttatactttagagcaaagtgagaccaacattaagacagctcttcttgcccttggctaacagcaacagatgtaatagctttgaacattgctgtacattaatttacttggttatttctcttctgtgggaaaaaaatggatatgatgccacttgatccctcttttttcataaaagtctgatgacttggaaactgttttgtaattattttttaatccttaaattcctgggatttcggtgatagatgtcattcaaacaaactggttgttagtgaaaatactgctatctgagcacatgacccttaaaaaatgattattttctatttctccacatcgttagctcttcagattcactatgattatttaaatatatgtagagcgaaatctaattattctggtgcagaacatttttcatacatttgtttaactatttcctactctctgtctgtcttccacccccaggtctcatgctttctccctgtataattgtttgagcagctagaatgttaaaattttcacccaataattgggcctgtcaaagccttagtgattaaagtatgtcatgtttaagaaagttttagaagaaatatagtgtttctaactttaatttttaaggcttatagttacggcatattggctatgatttcttccccatggatggcaagtgatgctcctatccgtataaagttaactggtttacattatttctgagtaagtcccagcaattgttcttgtcaggctaccactggtgtatgcttttgtaagctggccttgatcccaaagagtagggctaggaatctaacatgtgtccggttccatttctcaaccctctaaactatgtaactttcttagtgctgacacactcactggcctatattatttaatcagctgatcacagaaaaaagaatttgccagatagcttccattacatatgacttttcattttagaaagtactttcacgtatattatctcacttgaatctcataacagatgaggtcctattatcttaaatttgcaggtcaagagtagaacttagggaccttaatgacttgcaccaggttacatcactaggaaatgacagagtcaggtctttgactctggactgtctgtgttctttcaatcacgccattgcctggaatccattccagcatttgcagactatgagacagagctaagcatgtgtgaaagacccactgccattgttcacatccatcaagatggctttaaggctgaagaatgtgcaggcatctcagttggaaggcatgcgagcttgatagaaattgagacactaggaagacactggaagaggaatgaaccagcagaagacattttaaaggatattaagcctactgaacaccactgcttcgacatctaaatctttgaaatattatttaaggggtactgactttgagtacaagttagttcttgtgctacctgtacacaattcaaataaaagaagtattttcgttgaatgtcatttcatttgaaatatgtttaagtttgagtactttcaagcttattcattcccagtttgctaatatgtaaatgagagtttactttttctcttaaggcctttttatatgttttcaaatttcagtaggaatttaaagcaaatctttccatatcagaaacagacacaaatcaatgctttggatcctaagagcagttatttaaagtcagttaacttattgttggaactttgaattgctaaaggaaaatattttatctaacctcatttttgtattatttctagaatgtcaataacaactgtcacaaatgatatttttgaagagctataatgtaaaatggcattaggttgtcagtttcacttaccagcaagtaagatatgacttgaattctatacggggcctagcctactgtctttcccttggtggtattatttttctcccaatttcctcacgatgttgtatttacaaagttaagtacagaaaatccaatttgagaggctggaagcagatcaaatggtttaatgagctcagttttatttatattaggtggggaaatcaaagctgagactaataatttctgtgcccataaaagaataagagacctaattaagcccacacagtgaaccaggttagagactgcttatcttccacatttcctgtgtgaaatagtcctgtcccatctcatcagctttcatgtgaatctttaccaaggaagtgcaaatagaggtatctggctgtcctgaaaggatagcagcaggtagatacagtgtgattgcacccctaaattattgtttctggtgtggcacagacaaacagtgatccttgtcctggcttttgaggaaatacctaggaagatatgaattttatttcaaaagaagagtagtgcctagataggaggtatcataatgtctgcatctagaacagctgtaacatttggaattcagatctagctgcttcctgtgagcaaagatatacatccgagaaacagccaatgactgtcagcttgtaactgattgcctacctgtaagcatgggtcagcaccatattagcgtagtcttcagtcaagaaaagcggcaatcgagagtatcaatatagtgacacagattctaaaatcatacaaacaaatgatagcgcatgcaacttgaaaactttttgaaattgaaaaaacacagtggaatacctgatatagttactaatcacagtcctccaaacaatttcattttgaactagttaaaatagcataatcattatcttttttctagctttatctgccggattcgattgtagcagattctatccagtgtatttatcaatgtaatctagaatctatgatgacagatcttcatgagtagaatttataactgagtaaacctagtatttgtgctaaatccggacttaggcttaggtccatccaactactcatcgtgtcagtggagcccaaatggtgagaccactaaatttatcatcagggagagtttagtatgaactccaaaaattctctatggctttttgctgccataaaaataggcaggaaaaaatatttcagtaaaacatttgattcagaggctcagtaggttacctactccctgtgctttaaggtttatggaaagaaaagcatctaggcaattttctaagttctagatacatttgtagtcttatttatgtaactcctgtaatcaaggctaaatgcagacagctgagagttcggtttggcctgtatttacttgaaatggctaacacccatttacaggctcataaatctttcaagtgttaccactgcgtgcatttgtggaaccccacccccattcatgaacaactaaaattgggtcacagataagcttgattacttgtggggaaacaatttggggagatgaatatgtaatttagtttcccttaatgtgagggatgaatttgttccaacaggtttacaagttacagttttagcctgcagctttctgtgttgctattttaaaatgtcatatttaaaggagacacaagagctaaaaataagtaaatttaggtgtgaagtcctagggccttggggtaggacatttgggatcctatggatctttcgataactatgaagcccacagttgtctcaggacttacttatttttgtgtgtgggttaaaacagaaatgattgatttttccccattgaagataccacagataaaaactaattatcttaatggaaacttgatgcttaaacagaaacctttctttataaacaagtgtatattgaatttttacagttaataaagctagtgcttatatattaaaaacactcttgtgattcaaaacaccataatgtgtagctaaacaatgagttttatacaagtgctatgtacttggagtaagaagattaatctgcagctattcacaaggtgagttaggggtaagataccagagcccaggtgaaaagcaaggaggtccttgttacagtataaggaagtgaggaaggtgaggtgataaagtgggaatggaaaggaaagcaaatacctgatactggagataaagttgttgctgtatattcaaatgaaaaggtatatatgtgctctctttttcttttgtttggtttttgagttagggtttcttttcctgaattgtttagttgccagaatactgggtgaaagagatttggaaattctctctagtatcaggtttggaaatacaccatatccccatccatggtttctatttcagaatggcaaaaagatcctgggccacccaagctccagggctggcttgatgggcagggaactcagggtcctagcagtgctttctcctgaagccatgagcaaggctgttggagttacatttcttttttcgaaaattcgagtggctatactgacaagagatagatgaaaaacagggagtatcactaaaacgcttctaaaatattatttttgtttatttttaggacctaaatgtaataactaatatatagtaacttgtcacctacgtgtaactgaacctcagttctctcaagttcatcttttcgtgtttttcatcttaaataaccactatgtctcaaacttgagtacacagtggaatcacttggaaaactttttaaaagtagtactaattcataggcccaatcctaaaccaatttctgcacctagggcctcggggccaagcatgagtaggttctgaaatctccccagctgattctaatgtgcggcaggattgagttcctcctctctaaacactcacacctgtaacatctgtttatctcagttgattcttggtgatcttagccatttcttccattgtatggccaccctgtctagtgttggatgactttgaggcagaggagaatgacaatgaaattgaaggtttgggcattttcgtcctaagggaagaaaggaagcatgttaataatatcctgttttagaaacacaagcagcctctgtatgcctgaatcattttagtaggttaataaaccctaaagtattgctctattaactactgtctttactctgccaacatttaggatttgaaaacattaaacccttgtttacatcctctgtaagtcagcattgatttgtttctcttctgggattcagttaaaagcagtgcttagttgcacacacattttacaaaactgaactacacaaaatgatttaaaaatacaaagtaaaattcctaatccctcaaaaatgcccctgatcgtaggcatacttcataatgaacaatccagggttccataaaaattttttttgttattaaaaaaaagttactttgttctctcagaatacaaactacagcatgagcgttctccatagggtttagaatgcggcttattgctttaatgggttaaagttaaatctttcttttcagtagaaggcatgccctttaaatttcttgccaggctaagtgacacatgagacaatttatatccactaagatttcggtaacttgatgcaatagccttggcaacaaaattctaccaaatgaaaagcatcaaattgcgcagaatggtgttcatagccagtgggtctccccatcgacttccctgggaattgtgccaaggtaaaaggctttagagtttccattggttataaacggcagctttttgagctctctttagactaggaaagttgattacctatagcaagcttctctgaccaacactggcaaccttgagaccactctgaatccatcatcacaaaagacctgccacatattaattacggtataactcctcttctgcataattctccttctctctaacatttccgtgcttttctgttctgttttctgcttactctttctcttattcacagtttcccacctcctcccccatgcagaatataacttgcataaaaatcacacaagtagtcaaggggcaaagtcaggagctaacatgttacagaagcaataatattgcctaagggcaaaaggaagatttttttttttttaggccatgtcttatctaagccagatagttgagcattttaatacaaattatcaaaatagatgcataactactacccaaaaagcatatgggatttagtataaaaatcaatgacctttgtggacatagaggttaaataacagatataattactttttaatagaaaagatcattttttctgtttgtgagacataaaggaagggcatgctgtcagataaaacaatttgtttcagctgatctcccaagagactgccacaggcaaaagacatagccggtagagtacccgtctccccacccttctgctgcacattcagaatggcagcctgggaaccaggggcatcaccaatcagcaacagtgaaaagggccgcaaaacccacacattttcatttccattgcatttattctagttaccttcactgataaacagggaggtgaaacaaagctgttttactgttgtttcactgtgatcaatccagaaactatgaatatactgttaagaataagcttggcaggtgagcttcaacacgtgaaagcatctcagttctcaacaaggcaagagtgacagacttgaagagttaggcacagtttattgctgagataataaccaagaaaatgccgtctaataatgacggtaatacttaagtgcttactactcagtgctacagtgaaattgatagtactcttattatcaccatccccattttaaaaatgagaaaactgaggtacaaaaaaattacatacaattaatacaaagtcccacagccagcaatacacagcttagctggtattgaacctgctccaaggtcagtgctttgaaccattaggccatggttctgttaagctttatgaaacttctgtgcctgacaaacaagattaaatatttgcaaatgctctaaagctgaatagcatgatgccaagaaaggaaatatgaaatatttcatttgagcaaggcataaaacaatgcctttcaaaaaaataagccaaagatcatttcactgctttattgctttgtaaatattaattaagcctccattctaaagtcctgcgatttaattatgaaataatatttttcttctatctcagtacaattccctttccctacattccaacacagtcctgaaaagtgaacaatttcaagattaaacctctattcttgatattgaattaagtacacactattaagtagacatgactttggattggtacctccttggatttcagttatggagggaaagtggaagctcttagggaggcttcatgacactttgaacatgagcattcctgaactcagaggcgacagagccatttgtgctgtgagtggattttggaggagtgccaaaaagacctggcaggtaacaaaagttggtaacactgagggcctcagttaaaatgtgtaagaaataagtaagaattaatgtcttcgtaaagataagctaacctcagcttttatactgcaacgagaataggatccgagacccacagaaccagaaattagtccttgctgtctaactaggttggtgcagtggctcacacctgtaatcccagcactttgggaagccgaggcaggcagatcacttgaggccaggagttcgagaccaaccgggctaacatggaaaaactccatctctaccaaaaatacaaaaattagccaggtgtggtggtgcatgcctgtagtcccagctactcaggaggctgaggcaggagaatctcttgaacccaggaggcagaggttgcagtgaaccaagattgtgccactgcactctagcctgggcaacagagcaaaacacagtctcaaaacacacacacacacacacacacacacacacacacacacacacacactgtctaactagaggagaggagcaatctctcagttcttcatcttctaatctataaaacaaataatggactaaacaatggttgctaacctctttgataatctaacagaaggagtccctggactcctcatcctacaggttaaaaacttgtagattaaatccctcaatctctttacaatgcctacagtggtgatttctgttcatttgcaatactgagaaggtgagatacagtgagtgtatttccttggttggcaagatggcaaggccagcccagaacattgaaagatatggaaacagcataagaaggaaagtcaaaaaggctactgggctagttaggacaggcactctggaaggagggcagtcactgaggagatggctctgctctgtgctgaaggcaaactggaatgaactgacaattttgctttcaggggagggggtgatgaagagttcagttttgttctcctgctttagtgtactatgctttatacattggtccagactatctaatcaggatctcattaagggaaagcttagcattgtttgagttctctttcacacagcagagctaaaagtaaacagcggccaaagataaacaaggagcattgctttttcctgtgttgtacaatagttaagtctaatttattgacaataattgttggtagtataaatactgaatctgagatgaactttgcaaagagcctgctggtttttaagctttaccaagccagcagactttcttttgttgctaagggaatttttttccaaatcaggatttcttaaatagcaggctttgtatgctggaagacacaagtgacccactcactactgagatccagctttttttttctttctttttttttttttttaattctttaaatcaatgaatggctgaacttcaacttttctctgctgttgtttcttataaaagaagtagataagatagatttatgagcaaagaatagagcttctgcttctgaatcctcctttggggtcgtctgagtcatggtttaggaaagaattcctaccaaaatccctgaaacaatggaccaattccactattccctcttctccctcatatccagctatccccataaacccagagagaggacctgaccccgtaggagcaaaggtgccctggattatggtcctggtttgtgaaagaaaattgcatttaccaatatctgcctcacagttctttcttgactgattgcttatttactcctggctatatttacaaaacacttcaggccgactttgatatccttaaagttggtcttgatatcttttcattttgctcttttttgtccggcccaatccacaccctgccctaagcatattttctcagtaatgacgcccatttacacatgaccagacttatgtaatttactagatctatcctagtcatgctgcactatcttgccctcctccagtttaagacatctctaccatcaaggaccagcctctttaaacacaatctgttccaggcagatttatcatgacacccaacatgtctgagccaaagtccaagtgaaaacactagactctgtttttttttttttttttttttttaggagtcttgctttgttctgtcgccaaggctggagtgcagtagtgcaatcatgtctcagtgcagccttgaactcctgaggtcagggagtcctcttgcatcagcctcttgcatagctaggactacaggtgcacctcaccatgtggctaagttttttttattttacatggagacagattttgctatgttgaccaggctagcttgaactcccaagttaagtggtccttccacctgggcttccaaaagtggtagaattacaggcatgagtcactacacctggccaaaacattagaacttttttctttagggtttttaaaaagaaatgtatcaaatgtacaattccactccacattctactccttcatattatgaaagttggtgtatattttttccatctatctttttatattcttcatgaactacataaaaaattaattgatggagcgagactccgtctcaaaaaaaaattaatttatgcagatgtacctatccttcagcaatttgcctgtttaatcaatataatgttttagatgtgattccaaatgatatgcataactttagttgactcacttaaactattactttcatgtcaaggtatgaatatgatacaatttatttctctatcagttattaatagaaatttagattttcctgaatttttcattgttataaacagtagttcaatgaacacatttccatatacatatgtgcaaagtttctctggaacatgtaactagaaatgaaattgcttgacctcatgtagatatatcttaaatattagtagacattgacaaattactctgaaaaatggttgcaacaatttaaacataaccagccatgttgaaacatatccccacagcttcaccaacacatggtgtcttgctctttcaaatagttgtccaacaattttttgtaatcggttgtttattttttcttattgatttgtagaaattttatttatttcatgaatataatcatttgtcaattaaatacattgcaaatatctgcttctagttttccttgtcttttaaattccatatatcaaatgaagtattcaagtttgatacagtcatattaaccaatattttccttaactcttgattttaaaaaaatcacctacagtatttcaatgtcatactctcttacagtgttttctaaactatttaaagttttattttttacacttagatattctattcatctggaatgtattttgtgaatggtgtcaaagagggatctactttttaaaaataataaccaattgtctcaagagcatttattaagtaatatctttccccatttacttgtcatatactaaaattactattcacatgtgggtaagctctctcttctgttccatttgattatccctgcaccaacaccatactcttttaattgttgtatgatatttctcctttaatctgctaatgatgagattatattgatagatattcaaatattaaagtctttgaaatgcttagataaaccctttattttagtccactcttggattcaaattattatacttaattcagtttttgcatgtatattctaagtaaagcaggtttataatgattctttctcatatgtttttggtattttggtatctaaattatgataacataaaaaatgaagtggagagaaatggtacagtttttttaagatggagttctttgtgtgtaaagatttgtttaacttttgctcgtaaaactttattgattttagaggtgtagggtgaattttgactctaatttcttcaataatttttggtctagccatgttttctatttttattgagtcacttttgagagttctttttatgtttcatcttgtataaaatttaaattttatgatcatgtgtagacctttttatacttaacacaatggaaatgttcatatttattttttccccaaaggaaaaatttctgaatcatcactatgttgcacagtagaataggaattcaggtacttagtcaagttaagaatgcaaataacagacaagattaacttctaaagtctgaagtcatcaacatgattttgtagtactctgtctcaggctttacctaaaaattcattattattcagataaagataccccctaattacatgtttttgaaaagcctctgccccaccacaatttcctgagatctgtgaagaaactgcagtcttgtgatcagagtccatatagtactggcagttttgtaatcaaaggaaaaaacgtcgactgattttatatgtcaatcagttgtagtctgctgatctgattagaaaccttgacaaatgcctggtggcgattgcaaataactgccaatcatatagggatgatacagtagctcagtgttttgggatcagctcttgtacacaagtaaaagaacagaaacatctgtaagtaaggtattagaaaaataattgtccacaaccaaaaaggcaagaagagtaatcgagatttccaggagtgtgtccatgtggttccttcaaggggctcctcaggttgctgttgaatgtgttccaaggccagcctgttgtaagtctcattgatttcaaacatagtaaaatgctgctgcacttgctaacagatacaatcccactccaatctatctcatccgctgacggaagttcatcattctgcatgctctgtgccatggtcccgaaaaccttcctgttcccatggccagcattaaagagtcactcaactctgaataatctggtggctttggcatttcagagaaagccaccataaagtaaatcccctgggtcaccaggctgggagaaaggtctggagcaccagctactagtgattaagaaccttgtgactgtggcaggtcacaccccactcctgagagttctttttagaaaatagtttataatctaagtattcaaatatgttagcataagatgagtcatattattttctgatacctgaggttatgtctcattgtttttgtgccttccttcttcttatgatcaataatgccaaagattgttagtatcttttcaaagaattagctctttaaacacttatatttcatttatgtgatcaataaattttattaactgctatataccagactgttctaactaattgggtttctttttaaaaagtaaagagtaaactaatcctagatccctgcgcttgcggattttatgaggcagagataagttgttcaaaaaagaaaaaataattaattacgtgatatattaacaagataataaatgctatgaaaaaataaagcagagtgaggagaatcagaagtgccacatgttgggagcagcatgcgggctgcaattttaaagaaggtgggcagaaatattattgagaagatgagatttgagcaaagatttaagggaggcaggaaagttagccatgtgagcatcccggaagtaatattcctggtggagggaacagccagtgcaaaggccctaaggcgggagcaagctgggcatgtctggggattgcaaagaggccagtgtggctccaatagagtgaatgagagggagaagagagaagtcagaatagataaggatagtgagtctgagtttaagaaggctgtgggaggaatgacataatctgatttatagttttaaatataaacggaagcagagtagaaaagttatgatgctattgtgatgtaaaggcaaaaaatgataggcgtttggattaaggtggtaacaactgacatgtaatggtgaatttagagtcgtctatctctgctaccttcatttgtctttatttcaccaatattggcttatatcattagtattgtcttcctactttctatagttgagtcattaaccaccttgtcttatctgttttgttctgctaattataattatatatatattttactaagtctcttaattatataatttattctttctttgccttactaagtttttgtttttctcaacttaatctgtcagtttctgaaagaaacaaaatctcccattatggttttggatttgtaaatgttactttatattagtgtttgaattatatattttgaggctgttttctcttagatgcatatagatccacattgttatatcttccaggggaaatcattttttgagcctttttaaatctctatgaatgttttaaagacttactttgtatatgatttcctattagtattagtaccccagctttctgttctgctgtggcatttcctggccatttacttcagacttcaagcgtcattcgttattttaggtaaatcttatatagcacagatctggatttgtttatatcaaatctagagccctgttagttagtgggttttatacatttacagttattttgattgctaataaactttgagttatttctactatcttactttgtgttttctatgaactgagctttttgttaacttccttttttactttccttccattgatgtgattaaacactccactttttgtttactaatttgtatggtttttaaaatacatatacttaaaaacattttaagttaataatgtctttaacttgttcttgaatgatacaaggacctttatttccttgtgtggcttataatttttttattataagcatggctagagttttctataggaattccttgtgccctttgacggggtcctacatgatttaaagattccagaccagttttatgttactttctcagcttcatgttcctgatctctgtgaatagtgtgaatttggatgtcacatgtacatgggacaaggtttgcagttcaagtttctgactgttaactatttgccagtctcccagggcagtgagcaaagatttttctgattccctgttcatgattttggcagccattcatggctcctaggtctctgcatgtaattcagtcctggcaatgtgcaaacagggccctgacacctcctcacaggcattaaactttgcccttcccagttctgattctctgtgagccgcaggacttcagtcctattacccagtgtgacattttgttgtggctttatttttggcacatgaggatttatgattccaaattttgagttacactataaattccaaattgtattattcttatttattttttaagcagtttatttgttttgagcagggatgggggattcttacacatcagtactgtcaaccatattgacttgaagttcatctttcacatttttacatttaacagatattcaaatcttagtgattttttatattctgaatactgcattattcagagacattgttcatttaacatttctttttctcttatttaaagtcaccaaatattttgatttctttatgtaagagaaatgaagcatgcagaaattcctaaccaactacagttttgtgataacccgattttttctatagatactaaattttaaaaaatttaaagtttgtatttaatgtgattgctttctgtcctccaaatcttccaaaatatagctggaagaccaaatctagtataggcggggaggttacctaagcattttgctgaggcttgtgaaaaccagctatggttagtctaactacaaatgcattacatttaattttaataaggtttggtttacaaactttaagcaggttaaagtctacataacacagaactcatggaaaaatctgcctcactggttagactgaacaaagtttccttaaaatttgaagagagattcaagaagggtaatatgtcatggtagattattaacattaataattctgttttattttagaaaagaatgtgtttttagaagttttattcttaagtactacatcctcctaaagtcatccttccatataaatgttttgagagcttggcctaattccttatcacaagaaagtcagggcgtacagtgtcctcaccagtatctccatggaaacttgtgcttcgaatttctgctttccctgtattatctctctccactcttgattctagcttctttcaggtgttttcttctctctgtctcttatccacacagacatgaaggacagactccttttgtttttttgcatcctgccaaattctaaaagtacaagtcagagtgacaagcagacaaaacagcataatgggtgttttggtggacatcctctttatccccctgttatgttgccaaggctggagtgcagtagcatgatcatagcgcactgcagcctcaaactcccaggtgcaagcggtcctcccccttcagccttcccagtaggtaggactacaggcatgctaattttgttatttttttgtagagacagggtcttactcttttgaccaggctattctccaactcctggcctcaagcaatcctcccaaagtactgggatttcagatgtgagccgctgcatccagactaacatccttatttttaaagcttcctctgtcatctgtaacacagggacttttgcaatggctctgtttctccttccagccctatacttcttccaccatccagcctgccaccatatgttgtatgccatcaacccttttttatgtccttaattctcactgcctccctcttgagctgcctctggaaagaaaccaaattttcctcactttctgttgaaaagcaaatccatcttcccttggtgtcaccttgtctttgtcttgaggcccattcacttacttcccaatggactattaaggagttttgctgaacaaattatttccccaagaagaattctgtttataagattttaagataacattttcctcttccccaatatattttttagaatgatttttcaactctttgcttaaccccaattttctgaaatgctttgatattactaacttaggttttattagataatgaaaatttcaagaatgtaattcttgtgaatggcaaactattagtttatatttataatatttactaggctaatttagttagagcaaaaggaatctaaaaatatcttgaattgagaaaccaatgtagcttggatatgaatgatatagatgaaatcatgtatctgcctgcctagtttcaaatcttcctctatcacttactagctggtgtgaccttagacaagttatttaacccctctgttctttggtttcctcatctataacatcgaataataataataacaataataatctctatctcatatggatgttgtaagtaataaatgagtgtgtatatatatatatatattatatatatatatatatatatcttacaacaatgcctagcacctggtaggcactatatacatgtgtcagctaagatttccttacttacacacagaatctcaagaacaaaaatatgagataaaggaagcttgacagatgagggttttagattaagtattgtagatatgtgatgttaaaaatatacttaatgaagaaatcattatgtttaaatgtattctaatatacactaaatgaattcacaatatacttcacataaggaggtaaggcatgtatccttaaacagctcttggtatttttttctggctccttagaaaatctggtaacagtaacttaactcatttcaagagctatgttaaagctgggtatggtggttcacacctgtaatcccaacactttggaaggttgaggcaggaggattgcttgaagccagaagttctagaccaacctgggcaacaaagcaagagcctggtgggcggatcactaggtcaggagatcgagaccatcctggctaacacggtgaaaccctgtctctactaaaaatacaaaaaaaaattagccgggcgtggtggcgggcacctgtagtcccagctacttgggaggctgaggcaggagaatggcgtgaacccgggaggcggagcttgcagtgagctgagatcgcgccactgcactctagcctgggcgacaaagcgagactccgtcttaaaaaaaaaaaaaaaacggccaggcctgcgggtgagcgcctgtagtcctagttgctagagaggctgaggcaggatcacttgagcccaggagttggagtctgaagtgacctatgattgttcaactgcactcaaacatggacgacagagcgagaccctgtctcaaaaactatatatattattaattgtttttaaaaggaactatgttaaagtagtgattacccaggggattcacaatgcccgtgaagcacattcttatacctcagattaagaatccctggcttaagagtttctggcaggaaattaaatgcaagaaaataaaaataaaatatttttaaatgttaaagattatacaacttagatgacctttttgttgccagggactctgatggatctgaaatactaccctacttgctagctaataagttagcctgccacagtttcatggatactgacagatatgaacattctgggtcagagacaaagcaattttatcattcatggcatagcaagcagcactgctccatgttcgtatcagttctccttgccccaaagacccaggcaggcaacacaaaggagcccaggtgattgctgtgcatgcagtggacttgcatcacagctgaggatatccaagtttaggaaagcccaatcttttataacaggtacaagcaaacatgccttatcttttcagtagaaggacacgtcttttttgtactagacagtaagcaaatctgctgtctgctgtagaggaaagcaactgtgtctgtcctccaaagtggatcatatattcttaaaaaaaaatagtccagaatgaaagctgtcagtgcctttgcttgcaagccatgcagaaacaaagaaaaagagttgtcttccaatgtttgtcccatcaagtcaggaagggaaaatattatcatatattagttaggagaggggggataaagttagttatgtggatggaaagataactaataatctcttcactgtaatcaggaataagaaaagaacaaggtatatgtaatgtttgccttcaaggagctaacagtctggtgatagtgacaggctttaaacagataagccataaaaagattatttgcaatttagataagtttcaccagaagaaatgaagatttatgaaattatatattcgagggacttgatctagtttatgatatcaaagaaagtgtccctgaggaagtaacatttgaaaacaaggcctaacagacagagtaaagttgagcatctctaatcctaaaacccaaatactacaaaatccaaagctttttgaccaccaacatgacatcacaagtggaaaattccacacttgacctcatgtgataggccacagtcaaaatgcagtcaaactttgtttcatgcacacaattattaaaattattgtccaaaaattattgtatgtgtataaggtatacatgaaacataaatgaattttgtgtttagacttaggttccatccctatgatatctcattatatgtatgcagatattccaaaatctgaaaaaaatccaaggtctaaaacattttgggtcccaagcatttcagatacttcacctgtggtaggaattgtcaggtgaagagtagggaaaacaatattctgggtagaaggaagaccctattgaatgaaggaaccctgtattattagagaaactacaagaaagcgaggattactagagcagtgtaagataagcaggagccagattgggttttggacttgattctgatggcaatgcaaaggcagtgaagggttaagaaagagaatcacctcattatattagcattttaaaatgcccctccattgttgtatgagggatttgttgtaggggaagggtgaatgcagaccttagagttaagagcttgttgctacaagcccagcaagagttgatagtgctctggctacagacagtggcagtgtagatgaagagaaatgaatggattcaaaaaatatgtttataaagtgtagttgtcagacctgggtgattgatttcatctagagggagaaaaagaaggtcgtggatgattctcagatttctggcatgggcaactgtgcaggcagagtgcctagaaagaattaactagcctcttggggatttatctcataaattcacttctatttcagtgacagcaagcatcttaaatatatacacacagggaacctgattctctccagagccctaagaactaactttggtacagataaaagatgagctgtagggaattgagatgtcacactcacctcaatatacaggtagtttttacttgaattcattgaagaaagaataccattgtgctatcagttggttaaaaattgcacctcaaattttcctaccagtatgatcccttttaagctgtataatttacactggggtgtgatgccatcattaatgctccccatgttgattctaatgaggagtatgtccttttctcattctgagaaaagtatgctcttactacccacagatattctgaatatatagttgatattcaaccatatcaaatattgaacctggtgcttccaatatataagttattccttaggattaagaaactactgaaagcatttccttggagtatttaaaacgcagctgacaaaaatccaactcaagctagcataagaaaatgtgtagctcatataagtaaaaactttcagatcagggtaggactcaggcagccatagatacccaagatgttttcacgctgttgtcctgctccatgacttcctttctggagtcctttgttaccttcgttatcggttaggctttcttcatgaagtacaaaaggaagtcactggtagctccaggcctacacggtccatctgatttcccagtggaaaagtgtcttgcttcctgaccatgaaaacagggaagactgtttgagtcatgtattcacctctgaaccaaagctctgattgtccaagttgggtcacttgcttgccttggccaggctaactggaatcatatttggttctggttctaatctgttctccacaagaagaggggattttatcccagaacatggggaaataaagatggatgggcatgcaaacaaacaaataataaatgtccacttccgataagtaaattgggaaagagctgaaacatcacagaatgatttcagtacaggccagtgtagaattgcagacgtggaaggttaaaacaaggtacattgatataagatgaaggaaagataatgatgcagtaatatacattaaaagatggaaggactgtagtatgttgcctgtgaatcagcaggtgtcaagttttgaaaacaaagatgtacaaggatgaataaaaagtatgtctagaatatgggagtggtggtttaatttggctattttactactcttaaattagatctttgtatctgaggtggaactcctcagctaaagaaaaatgaaaacaattggaaagagccagaagagacctatgaagatgagtaatgggtagaaaataaaatttaaaaatcaataaatatatatgtagtgttttgtccatgcaaaataaagccctttgaggaggataaaatgtagaaaattattgtaatagcaaaagagaaatataatgcttttacatatatggtttcaattcagaaaaaaatgcagctatttttctctttgcatccatactcaaaataaaacagaataaaagaagttcaagcaggtgcacgaaatatttatatgagagataaatatttttaacttggaattaataactgttagaatgaatttcaagccttctctgagatcttttaaaatagagttccttctcatatgtttgggctgtggggcactgtactgctcaaaggtaaagtgaccagttagacgactatatgcttcatgaggacaggaatcctgtgttgggtgaattcacatctgataggctggagcataatggtctctaaaatatttgctaagtatgtgttgatgttaatttgcatttcacttagttgttaattatatatgtttggaatctgctttatggatctgcttaacaaatattacgtttatattaggtggtatcatcatacatacatggcatcatacatagactgccaactttctagctgctgtgttttcagtgaatagaagctagatgtgctaagtaaaagatgatgacaacaagatactgatagaatttccagttatctgcaattttggatcatctgatccattatctccatctattatcaactaagcattcatttgaagagtaattatggaagatgaggtttgttaatattataagttatactgaatacaaaggacaacggtcataacacctttatgaatagactcaatattgcatccaggtcatcatggaattgagcaatagaatttaggttcagtaaagaaacttaaggaccatcttctacccaatcttctcttcttctctagttatctcattatttaagtgatgatgtgattgaaacctaactatgttaagagacttgcccaattacactgttggtgggagtgtaaattagttcaaccattgtggaagacagtgtggcaattcctcaaggatctagaactagaaataccgtttgacccagcaatcccattattgggtatatacctaaaggattataaatcattctactataaagacacatgcacacatatgtttattgcagcactattcacaatagcaaagacttggaaccaacccaaatgtccatcagtgatagactggataaagaaatgtggcacatatacaccatggaatactatgcagccataaaaaaggatgagttcatgtcctttgcagggacatggatgaagctggaaactatcattctcagcaaactaatacaggaacagaaaaccaaacaccacatgttctcactcataagtgggagttgaacaatgagaacacatggacacagggaggggaacatcacacactggggcccatcgaggggtggggagctaggggagggatagcattaggagaaatacctaatgtagatgacgggttgatgggtgcagtaaaccaccatggcacatgtatacctatgtaacaaaaccgcaggttctgcacatgtaccccagaacctaaagtataattaaaaaaaaaaaaagagagagagagagacttgcgcaatttgaaataacctctttatggcagaaactgaaccaaaacctacttgaaagaatttcaatttcctgaagctagatgagagttttccaaggcctagcttaacatcaatattaatttcaattggtcaatataatctctaccttcatatcatcttgagactcaattggttggccattttcatgatgctttaagaacaaactcaacacagacattaaacacatgcatattatgttagtttttccttatctatatttaaggaaagtattatatttgaggagaacttaggggatgtggctaaaattagccctccactaggaagtatttttgagtgtgaagaaatgtggaagttatttaactgttttacagatgttttaaacttgaggctcttagttttattgatttactgtgatctaattaatccattcaccactgaccaaggaagtcatagtgattcagttcaaaaatctccccaagccctgcctgaacttctctgaaatcagtagagtagttaatacatgatgaaaagattgtggtttgctacagaaaattatctttatcttaaataataaaaacaatcaaggtgtcataatggtgggagtcaccagcaatggtaatgaattataataaatatcacagtacagttgatatattaaaaacaacagctttcttacagccaccaagtaaactgttttatatcatttacagctaggccagagttgtcccttggacataaggagacatgcctaccttggatgttcaaacaaatgttatattgcctaagcaggatatgttcaaggttttagccaatcacattgcagacagctatctttaaatattaaaggttatttcaaattgcacaagtctctctcttttttttttattatactttaagttctgggatacatgtgcacaacctgcaggtttgttacataggtgtacacgtgccatggtggtttgctgcacccatcaaattaaccatcaggataatttaatctgaattgagtttcagtattagaaaatagagcagccttttaaaaataatgccctccacattagcaaacaatctctgtcctgtttcctttatgcagttataaaattatggatgtcaggattttaacaaacttgtgcttgtagacccataaatgggaggcaccctagaaagcagcctccatgacagtttcacatgtgattcagagtgctgaaagggttcactgtttggcttcaactctttattgagatccttaaaacttaatttctgggtgttttttttttccttcacaagagaacaaacaagctatatttcgagccagtagtaaccccaagcatttttattaatgtttgctcagcaacagtctgagctttgtatggttgctttatccccagttcactgtgtatcagcaatttcctgttcaccatctgggaaagtcagatgtaactcttatgagaagaggcaccaacgtttcctctgtacttcattatttcagatgtaatcaaaggagtaaatctacagtgtgttcttggctgtaatacagtggagttgtccattgtctggatacaaatccatttgtgttcatcttctaaaggaaactcttttccagatacagttctgttaaatactatatcaatacttaatgcttaaggtttgtcaggttcaagctgataaaccctacttttaaaaaacctaatattcttatatcttgatggtgatactcttcggggctctagaggttcttgctaccacttttgtaaggagacattgctcagtgcccagccccagcagcctttttgttcagagaagcagtgtgcacagtggttagagcacagactcgggagccagaccaatgcttgggttcaaactctggttctgcctcctcctaggatttaaccttgagaagttaaataagctctctgtgcctcagttcctccatttataaaatggggattataattctagtaattacctcttaggattattgtgaggattaaataagttattctaagtgattactgaaaagagtgcttagcacttagtgggcaatacttaaaggttagatatttgtatagctgctcttatctcaaggatttgcatttgctgtctcttctatctaggatgttctttcagactccacatggtatgccctctccaaatgtcactcctcaaataggcctttcctggtcatctttttcactgttcctatttgctgctttattttttttaaaaccttgaccaccatccaatattatattttatatttattttatattttgaactccctgtttcttcaaaaagaaagcaatctgagtgaggtcttttgtataagactgtatacttggagtctagaacagtgtctggaatgtgtataggagatactcaacaaatatttggagaatgaatgaagaaattattatagaaagatatttatattagaatgcatttctgtagatgcatgaatctctctatcagaactctccagagcacaaaataatcacaattactacaagataaattagatcttggtttaggctgtgcttgcactgaattgaacactaagctcatatgaaacacttaagattgtctgcagtgattcacaacataagcctgatattttagtttgacttctcaaagtcagttatattttcagtataaatgaagtaaaacatacacttgaaactgaaaaaaatagtacaagtttaaagatttaagacagttctctacacacaaaaatgataatactttctatcactggtcaagaaaaagtcacttttttaagtagtaatcacttgtgtgcatttttttcagtattgctattaaaagaactttctcattttcaattttgaatcattcaacaatgaaatgttagagctgttgccttgctttaccacataccacagggtaaaatagccaaaggttgtttaagtgggttaagtaaaaatggagaatgtcagtaaaatggaagacctcctaacccacagcagaattgcacttgctttgatactgttatttcaataatgtcaaacaaaaatgaattgactttgccttttgaaattttatttaggtacacgctgtcagtactttaaagataaaagaataaatgtttcttctttcttgaacccttgttatgtaccagtatgcttagcattgagctggatacaaaaatgcataaagttctgttcttgaaaagtttatagtctgtttagagcaacaagacaaaaaacctgtaagaaatcagtacatatcagtaaatcattagtttctaaagaaattcagatgtaggaagattattgtgggtggttgagaacacaagaagagagtgatgctttgccaagcattaaaggatgaaaagcattttattaggtaatttggaaggagaagagaacattccatgcatgaaacacagcctgagcaaagataaaaatgagcaaattataccagacattcaaaaagaagaattggcaccattactgttgacactattccacaagatagagaaagagggaatcctccctaaatcattctatgaagccagtgtcaccctgataccaagaccaggaaaggacataaccaaaaaagaagactacggaccaatatccctgatgaacatacatgcaaaaatcctcaacaaaatactggctaacggaatccaacaacatatcaaaaatataatccaccatgatcaagtaggtttcataccaggcatgcagggatggtttaacatatgcaagtcaataaatgtggtatgccacataagcagaattaaaaacaaaaatcacatgatcccctcaacagatgcagaaaaagcatttgacaaaatccagcattcctttatgattaaaactctcagcaaaattggcatacaagggacatacctcaaggtaataaaagccatctatgacaaacccacagccaacataacactgaatggggaaaagttgagaactgcaataagacaaggacgcccactctcactacttttcttcaacttagtactggaagtcctagccagagcaatcagacaagagaaagaaataagggcatccaaatcagtaaagaggaggtcaaactgttgctgtttactgattatatgattgtttacctagaaaaccctaaagactcctccagaaagtttctagaaccgataaaagaattcagcaaagtttctggatacaaaattaatgtacacaaatcagtagctcttctatacaccaacagcgaccaagctgagaatcaagtcaagaactcaacacctcttataatagctgcaaaaaaataaaatacttaggaatacactaaggaggtgaaagacctctagaaggaaaactacaaaacactgctgaaagaaatcatagacaacacaaacaaatggaaacgcatcccatgctcatggatgggtagaataaatgttgtgaaaatgaccatattgccaaaagcaatctataaattcaccacaattcccaacaaaatatcatcatcattcttcacagaactagaaaaaacaatcctaaaattcatatggaatcaaaaaagagcctgcagagccaaagcaagactaagcaaaaagaacaaatctggaggcatcacattacctgatttcaagctatgatataaggccattgtcaccaaaacagcatgatactggtataaaaataggcacatagaccaatggaacagaatagagaacctagaaataaagtcaaatacagccaactgatctgtgacaaagcaagcaaaaacataaagtgaggaaagataccctattcaacaaatggtgctgggataattggcaagtcacatgtaggaggatgaaacaggatcctcatctctcaccttatatagaaataaactcaagatgggttaaggacttaaatgtaagacttgaaactataaaaattctagaagataactaacgttggaaaaccccttctacgcattggctcaggcaaggatttcatgaccaagaaccaaaagcaaatgcagtaagaacaaagacgaacagctgggacttaattaaactaaagagcttttgcatggcagaaggaacaatcagtggagtaaacagacatcccacagagtgggagaaaatcttcaccatctatacatctcaccaaggactaatatccaaaatctacaacaaactcaaacaaattagcaagaaaagacaaacaatcccatccaaaagtgggctaaggacatgaatagacaattctcaaaagaagatatacaagtggccaacaaacatatgaaaaaatgctcagcatcactaatgatccgggaaatgcaaaccaaaaccacaatgcaataccaccttactcctagaagaatggccatgatcaaaaagtcaaaaaataatagataccggcgtggatgcagtgaacaggaacacttctaaactactggtgggaatgtaaactagtacaaccactatgaaaaacaatgtggtgactattgtagaataaaatagtactgatctgggagttcaaagatctgaatttgcgctctagttgccacgcctagtaactgtgaacaaatttcttagtcaaacagttcccttattgttataaaaaagataatatcctttatttttccataatttttctctttacatgtatgtattagagttctctagagggagggacagaactgtgaggatagatgtgtgtataaagagaagtttgttaaggagtattaactcacatgttcacaagatgaggtcccacaataggctgtatgcaagctgaggagcaacgaagccagtccaagtcccaaagctgaagaacttggagtctgatgtttgaagataggaagcatccagcatgggagaaagatgtaggctcggaggctaagccagtctcatctttccatgttcttctgcctgcttttattctggctatgctggcagctgattagattgtgcccacccagatgaaggttagggtctgcctttcccagtccactgactcaaatgttgatctcctttggcaacaccctcacagacacacccaataacaatactttgatccttcaaacaagttgacactcagtattaaccatcacagtgtgactaatgtgttaggattcatgaggtctaatcataaagtgatactattttgtcactggttgtttctttataatttattcaatgaaagaagtcttctgccactgaataaaaccttagaaaacttcttgaaacctctaataattctttggaaatagaaagccttgtgattactgtaaatcacaaagatagtcttgacgcaattatttaaaaatctagtcccatgggattgtcaaagtagctaactttatttagttaaaactactatccttccaacagcaaggacttactaaggcataaagtttatgaatagggaagagcgtgtggttagcctctttttccctgcctctttacacttctgctaattaatctttatttctgtctcttctgggttggaacatggggaggaagaatatggaagagaggcaggaaaatactggcacatttatttgattggtactgtcataagttggctgccatcctctggacagttgcttatgatttgcacaatctctagcaactcagtaccttctgcctgtctctgctgaggcctaatggcccttccagaaggttctatcagacaagaactaggatcatattattctagctttctcttgtgcaatgtaccagataaatctgtgcaacactttggcccaataaacttttgaagtgcaagtttacccaacctaaccacctctttttctagcctgctgctagagtagcaagccagcctctctctcacactggagattttccaaagagggtcaaaaccagaactcttcatcccttcccctcagctccaggggacacacagttacttctacatagcacaattgtaggtatcttgttctctctttttcctatacaagtgcatgccaaaaaaataaataaataaaactaatcctttccttttctaaactttctttctctctttctgactttctttctctctttcctttgacatgtaaagatatctagcctgttctcagccacgtagtttcacaagttgctctgatgctttctgtcttccagcttacttcgatacctgatgccttaggttcttgatcaaaacttccagtttaacagcaagatctatcaatttttgtaaagtgacttaaataaatgaaagtcgcaaaaaagatacagctttttttgcatcttcagtagttaggcaacactaacagaagtttatttgactctagttactttgcctacaattccattaagtcacctgtagatgggtgatggtgaccggattataaccaatttatctaaaaacccaggcctattggtgtgactttcatattgcagcctatatttatcatgcattctgcttttccttaaaaaaaaaaaataaaccaagaccactgaactgaaccaattgataattatccatgttaacaaaatatatcttaaaaagtgatatggtttaaagatttaagaataatttctaggtaaactagtaaacctttctcctttaccctagagtttatgtgacacagcactggtttattctcataaagcttgtgtttgtttatggatttgtcactggtttatccccataaattcacatgtttgtttatggatttgtcaggccaagtctctgtttaaatgcattgtctgatgatccaggatgtctacttcattcttttgaaatagttaagtctaggctcagtggaccttacagttaggataacagcagattatttcagcattttaaaaaaagtcttaaaactttccatatggtgatctacttggaacaagttagcccatttggaataaatgattaaatacttaactaaatacacgaattttacactaaatggccatacctggacacttgttgccctttatattaattcaaaatcaagacaaatattatcactcaatgtaattctggatagcttgtgtttaggcaaacactgggatttaagggatgactataaccaaatgaaatgaattttcataagaaaaatggcaatctcagacaaatataaagctcacataaccagtgtatcttgattatttttgaagggggagtgctttagatgaaagaaacaaactggttgtaagcaagaatgacaatacagtgctacgggttccacagggccaactttagggcttgagcatccttagattttggtatctgcaggaggccctggaatcaatgcaccacaaatactgagggacaactgtatgtgaggtttggaaacacctcataaaaatttacagacttatcagttatctaatgcaactgttcctctgacatgagtcatgtgcgggcctgccagggagaattccagatgtcctcctccagatcctgctggtaaggaattagaaaaataattaactataccaatctgggtacttgtgctgacactaagggtctacattttttggaaataaagcattaggactcttttccagttggataaggtattccttgggtggtatcttgacatttgaggactagcattaatttgcttgaaacaacagcatgttaataagaacactgcaatattaattcagtatatcttttcccgttgttctgaaagagacatcagcggtctagctccctgatttggtagtaggaaatctcaaatctcagtttggcttctaaatagtgtactttgtgcctctgaccctttcatataaaattaacaattctcagcacttcacaatgtccttatcctattttatttttccatcatggcattgttgatatcattatcaatatcaggtatagtatgtatttatttgtatgcattttcatattttctgtatttcaggtatctgtgttggattctggcttgggtttaaaagacagttttttgttttttaaaaaagtctttctaataacttagctctgaacaaggttagactaaaaagaatttgggaggctgaggtaggaggattgcttgaacccaggagttcaagaccacccttggcaacatagagagaccctggctctacaaaataaattaaaaattagccaggcatggtggtgtgtgcctgtggttccaggtactcaggagctgaggtgggaggattgcttgagcccagaaggttgaggctgcagtgagatgcagttgtactgctgcattccagcctgggtgatggagtgagaccctgtcttgaaaaataaaattaaatatttcaaaaggatccagacaaagtgatatccactagaatgtaagctccaggagggcaaggactttttgcagctgcggttgttcacttctctaaccctggagcctcgaacattttctgacctatagccaatgctcaatagtcaggaaggaatggagattaaaattaatgcttgtcttatggatttcttgtgaagattaaactaaagattgcatataaacttagcacaacatgagatacagaatccaaaaaccctaaaaggctccttatggcacccagacttttaaatgtatgaatttcatcccataaactgaagatactgattatatgcatgttttaaatatattcaacttctaaatattatacaggaagtccctgattcacaataattcaactaaacagttttccaactttagaatgatacaaaagcaatatatattcagtagaaactgtactttgagtacccatacaatcattctttcactttcagtatagtatttaataaattacatgagatataaaacactttattattaaatacgcttgtgttagattactttgttcaactgtaggctaacgtaagttttctgagcatatttaaggtaggctaggctaagctataatgttcagtaggttaggggtattaaatgcattttgacttaggatttttttttttttttttttttttttttgaggaagagtctcactctgtcgcccaggctggagtgcagtggcgcgatctcggctcactgcaagcaccacctgccgggttcatgccattctcctgcctcagcctcccgagtagctggaaccacaggtgcccgccaccatgcccagctaatttttttgtatttttagtagagatggggtttcacgacgttagccaggatggtcttgatctacttaggatatttttgacttaaaatggggttacatcccaatgagcatctatatttggcatccttgtttatgtaagtggacttttttacaatgatgagaacctcactctgatgtcattaacaattcaccttatgtttgctatataaaaacttctttcatataaaaggtggaagaatatcctgtttacgatattcattttagctaaccatagactgaagaccacttgtgactttatttgatctgtattttggcactatttatttaataattattacagccaaaactagagaacaaacttattggtttttcttttttaaaattaatctccttttctttttcttttcaatagttaatctagaggcagtgctccactttgaactttaagcaaatataagccttaacattagggtctctgcagtgagtttttataaggattgaagaaagggagctacaagaaataagacatcaaatcttaggttgtgtgatagcctgataccttccatgttttcttgaacatttcttctaaaaaaaaaaaaaagtgtattttagaatctaactttccaaaattgctttgtagtagcatttactgaatggattgtagtgttttgttaatagcactgttttgttgatagcactgaaaaaaatgaaaacctctgcatatttctttttttttttttttgacagaattttgctctgtcgcccaggctggagtgcagtggcacagtgatctcagctcactgcagcctccacctcccgggctcaaatgattatcgtgcctcagcctcccgagtagctggtattacaggcccccaccaccacgcctggctaatttttggatttttagtagagacaggtctcaccaccttggtcaggctggtctcgaattcctgacctcaggtgatccacccgccttggcctcccaaagtgctgggattacaagtgtgagccaccacgcccagcctagacctagcattttaagtatcctgaggcttgttaaagatgtctatgtcacagtccagttgtagtttaagagaaacttttctgtatcaataaagggcaaatttagattaaaaaagtcagggaataaacagtatcaaaggcctctcctccccccagaaacatgcttctatagtattcttcagtttgctgatctactcaatattaatgctttcttcagctgttaagttttgattcattgcaggctaataaaggaaagtggaatttttcagggcgtggtgaattattttacctctactacacttcctaaggcccctccactcagctttgatcttatggttcattccttgtcattttcattgggttgaagggacctccaaagggaacattggtttaatcactgcttccttcctaatgtagctctgattgctaaactgtctggggttcttttgaaatccttatattacagctctcttgggctttcctctgcaatcacccttcacacagtctttattggaggggttacaaaatgatatatgtcactcagtctctctaggccctttttctaaaattagtaaaatgcacagtccttgtatctttggaccctcaagcctttattttaattctatgtgtttattaattgtggtccctacccctcagaatcagagcacatatacaaatccttgaccttgaaagttttatggccccagagaaacaaagattaatcataattgttatcttcctgaaaatctcaagccctgcttccctttttaagtgcacagatgattcctgaaccaacaggaaacaaagttgagaaatttttgagcgtttcttttctttgccattgtccagaaagagaatatagttctcccaagactgtccaattcattttcatattgttaaagtaacaaatgtccttcttgattctaatctcatctcgttcttggcaaataagatttcactgtcttaacttccctgcacataataattcactcctttccttgcgctccagccaaactccaggtggttttgctatcacatttaaaacactgtctaagttactgcatagtgtgagcctcttctccataccaaactctgatctccagctcaggaagcatgtcttattcatcactgtatgtccagagcatagcaaatagcatgcacatagttactgcttaataaatgcatatacaatgaatgaataatgaatagcagtcatgtagaagtcagtagtgggttttccgttagcataagatcaagaattttgtccattatatggcacaatagccctgctgctttcatactgaaagttgtgcttcatttcaactactctgtgtgtgtttgtgtgtgtgtgtgtgtgtgtgtgtgtgtgtgagagagagagagagagagagagagagagagacaaagactctgaaacagctgctaaagagagcaaaccgggatgaatgtataacctattattagcagatagcattttgataccccactcctagttcaatcctagtttatttcttttttgcctcatttctctcatttttaatttttttatgttgagcaactttataagcaacttaaaaccttttttaggcacatcagttaatcttttgtgttttgtagaaataataaagaagcataaaaaagatctagtccctctttgctgaagaggaaagtatggggcaaaaaatcatgaggatgctatttactgctgcctggatattgaagtaacatgttaggagcctgtcttagtccatttgggatactataacaaaataccatagaccaggtagcatgtaaataatagacacttatttctcttggttctggaggctgggaagttcaatatcaaggcactggcagaaggatcccatgttggtttatagacagccatctttttgctataacctcccttgtcaggaaggcaagggcctgtcttgggcttcttttataagagttctaatcccattcataagggctctgctctcatgacctaatcactcccccaaagcccttcctcctaataccatcacgttgggggttaggatttcaacatgtaaattttgggaagatacaaacattcaaaccactgcagaacctttaatagaactgcctcatcttcaaagtcacaatagaggaggccactgagattgagtgtgcttccccacctatcaaaacagcaaccataaagaacacatccctgagtaggtaagtaatctacatcccaacatgaaggcttaattaccatttcccctttctgtgattttacacgtaggatttactgtagacagttttgagttaccttgacagaaccgaataaacatttaaacacatattataaaaaggttgtaagtttttcttgctttcaaatgactgagcaccaacccagagccttcacatttaactcactgctataagtgctctaaaggaaatgtttgctcttctgagaaatggtattagacactggattagaggtgatgacaactttgtggattaagacctctgataagcttgctgttgcaaatatatatatatatatatattaaccaaacatttgaatagcatgtaaaatgaaatatgaatacagttaagtgtcatatatgatttctatacatgagtagacattacagtgttacagcaaagaaattaaaccaatttgcatactaaagttaatgataataatggctgtcctttactgactccttatcacatgctaggtatatgctaagcactttgattacctcatttatccctcacaacaaatttatgggggaaaaaatagattttatttatattttacaaataaggctaatgaggctcagacaggtaatttctttcacccatagtcacaaagctattaaaaagcagtgctggtgctcaaagccagggctatctgattcagagttcacatcggtaagctcttcactttctcactgttttgtgaaattatcatgttcttttcttcacttcagaatgacccagacagtggtgagttttggtgtatttccacacataatccaacccagtgagattagtctctgttctatgtgacaacaggcaacagaatctttaagcaagtctttaatttagaggttggtgcaaaagtatgaattttaaatcattttataactaaacacatctttattaatcaaaatagaatccattacaatgaacacatttttgccaacaagaaataagtttgtttattcctgtagtgtaaaaatctgtgcttctggatttgatgaactgttggaaagcattttctgcatcctgctggttgtggaagcattttccctgcaaaaagttgtcgagatgcttgaagaaatggtagtcggttggcgagaggttaggcgaatatggcagatgaggcaaaacttcagagcccaattcattcaacttttgaagcgttggttgtgcgacgtgtggttgggcattgttgtagagaagaattgggccctttctgttgcccaatgccagctgcagcgttgcagttttcagtgcatctcatcgatttgctgagcatacttctcagaggtaatggtttcgccaggattcagaaagctgtagtggatcagaccagcagcaaaccaccaaacagtgaccatgaccttttttttggtggaagtttggctttgggaagtgctttggagctcggtccaaccactgagctggtcatcgccagttgtcctataaaatccacttttcatcgcgcatcacaatccgattgagaaatggttcattgttgttgcatagaatacgagaagatgacacttcaaaacgacaattttttttttgaattttctttcagtcagctcatgaggcacccacttatccagctttttcacctttccaatttgcttcaaatgcccaatgacagtagaatggtcgtcattgggttctttggcaacgtcttgtgttgttgtaagaggatcagctttgatgattgctctcacttggtcattgtcaacttccgatggctgcccactaggcttcttatcttcaaggctgtcgtctcctttgcaaaacttcttgaaccaccgctgctctgtacatatgttagccactcctgggccaaaatgcattattgatgttgcaagttgtctccactgctttatgagatattttgaactagaataagaaaatcgctcgaatttactttttgtctaacataatctccatagtctaaaataaacataaaacaaacagcaagtaataagtcattagcaaaaaaaccataaatcgagaaatgcccactaaaatgatgtataatataaccacatttatttaagaatgtattccattatcaaatggcaaattccaacaatggaaattccttttgtaccaacctaatattttctcctgactcctctccacacacctaggtaataggccaactatatgagtaaggaagagcagccctgacctttacgaaaattgtgttgtttaaaagcacatgataccttcccaaatgggatggatatcacacttttgaattttcagtgtgtttttaaattatttccattttgtagcacatgcaagatttatttgaagaaagaaaaaaaataaagaaaagaacaaataaactattgtaccatcataaagggaagtgtttgaagatattagctggcccagctccacaattaagaagtttggctacaattaaaaacttaagaatatcagtcaaaaatatttactgtctattagatcatcatttttttaatgagaagaaatttagaaagtgcataaggagacagccttacattgtttaaagccagttttagactatttggacttttcttatacatgcatgagtatgctcagaaattcaaattactctgctgttcctattttatttcactgccctgaaatcctgttgttgaaactacaagacttgaaaataacaggaacatcctgttgacaaaaataaattccttatgataaaatatttttcaactgaagccaattttttttggatggggaaagggccttggtgggagaggggattgtgagtgacagaatgttggtttgggttcattgctctttcctcctagctttgctctctctccttctaacggaattagttgtattattttacatgaatttttgtattatgcaaaaatgttgatgtgtggtgtctttgaaaactgttttatggaaggaatacgtgtgtctgtgctgcccaggtattactagtgagtattatacttaggaatgagcatgtttagtgtgatgttcactaaacacttgatttattcaatagtcccctaacccctgggaatgcatatgcaaagaataaaatgtttcagacatttgcttaacaagggattttagattatttgcagaatatggtccctgaaaacattttaggttatttttccatggagtctgacttacgctgagaagcctcattatagcactgaccaggagtttaaacagtcaggtgctgggcaggcctcagaagtccttgcacttggtttcttcacccatcatgctggagggagggtggcatgacctctactatcccttctagtgctcagattcaatgaaggaacttattttttaaagaaggaagtgctgttatctttctaatgggcagctcagaatggcagggatattaatagtggcctgcattccaatagtcaacactgagatcttccagcagtcaccccatccagaatgcaggctttgaaaggctagaaaccctccctcttccataaaatcgttaggtaattgacctttttttttttttggcatcttttgccctctttttggaagctttgtgggagtgggacagtagtatggaagataagaaaccctaagtttaaatccctagaaaagcccctgaaccaatagtcaatttactgctgctaacaccactggccagactggtttgtcagtcactggtggtgtgatggtgtcatgttgggcttccttattacgtgcctctttttgaatgacccatcattaccttgacttttcaaattggaccaagtttcaacactgattttgcagaaacacacatgagtcatgaggaaaagtagcaaagggaaagttttcctccttcccctcatgcggacgtgctgtggacacaggcagacaatcataattgcatgactgagtcaccttacacacctgctgatcggtaaagaactcaagagagaaagagctgatttcacctgcctcttccacaaagtctcctgactaccccaactgaggcactgttttctttcactgaactcatactgcacagcacttttctctgacacataaataaatgtgatgaatgttcacactttcctctctactatttggtatcttctcttttttaatgcaaattaaatcttgtatactgtatacataggaggatttgggcttagcaatagacgacagtgatcatggttatcttttattgagtacctacggcatgccagcctctgatccaagacctttacatgtattcactcatttggttctcactgcactcttgtaaggtagatgccattgttttccctattttattttttggaaaactgagctgtggagaagctacatactgagtatgtggagaagctacatagttgcaaagtcaataagaggtgtacctgggatccttccaaatatctggcctcagagccttcattattaccagtattttttttgcaagcagaattattctaacccatcagtaaaaggcttctcctcactctgtccttccccctacattataccctcaacagcaagatcattttcttttgagaagcttctttacaaaaatcataaaggagctctcttgacatctgtctatctagctcattagacgtgtctagtttagggcagttcaaattgggacttttaaaatgttgcctctacatatgtatgatctaattcttaccacttcaaagcttcagggaaagtgaaatgtgtcatttccccctcaatattgggaattccccataaagtggataaaattttagcctgtatttccttttagttttactttcctcttctgaaattaattcatgacctctatctcaagttttctccagatttttggcccatatttctttttaacatttatcaaatatcccttgcatattggccttttacatttcttaagtttccagttttaactgtaacattgcaggacacataaaaatgataaataaatactaattaatagtaacatcatagactagcaacaatccaatatgagcatatttagggtttagatatcttagtacatttttatgtactaacccattacacagcaaacaccaacgtccttacatatttattcaattaaaaaattaggataccaggattgaaatgggctctgcaacagagctgagtattggatttgagacataagtcatctacaacttaagataataaccttaaaatgatggacatataacctcatctactcacactgtcactgttttcttgctgtttgtttgtttgttgctggggggcggggcagcagttttggttcttttgcttgtttgtttgtttggttttttgagacactctgttgcccaggctggagtgcagtggcatgattatggctccagccatcctcccacctcagcctcccaagtagctggaactacaggcacactccaccatgcctggcaattttatatgtgtgtgtgtatatatatatatatatatatttttttttttaatagagacgaggtttcaccatgttgtcaaggctggtttcaaactcctagcctcaagaaatcccccaacctcagcctcccgaagtgctgaggttacaagcatgagccaccacaccaagccactgttttcttaataattgaaagttaccttactatttccagaatttcatgattaaaattttaataatagtgcaaagaaatgtatagtgtattttaaacagagtatgactaactttaaccgatgatttcttaatggttttaagttatttaggatcaccagttattgcaatgtgctgcaaatgttaatgtgactaaagatggcaaatatgggtgtgactgaatgttcacccctgcaggggatgctctagaagttttttcttggagcatttgtaactatcacataaagccacatatggggctaatttccaggtcagtgtaatgtggctactgttctctaaaatgtgatgaataattaaacgtttaattatccttctacaaaatgatttttgcccttttgaggaatcaaaccattgctgtgaggatttttttgccagtcagacatctacaacatgaatagtggccaagagtgacactcattgggcatagacccatccagaatgcaggctctgaaaggctagaaactctcccttttctagaaaatcattaggtaaccagccttttctttccaggcaccttttgccctctttttggagcaagaggtaagaacaggacaccttgaatactctaggacaacgatattttccagtaccaaacaattttgttttatgagagaacatagagcattcatacatacaaaaaataacaagtcagcctgaccttattctgatgaaatgctgatggggcttgattcactggaacctacctggaatgaagttggcaagcggtgtccagtggatttatttcagcagttttatcaagttgcttagggaacaggctgctcagacttgagtttcttggaaaaagactttaacctactaatagttggagtccattatttgcctttggaattatatgtaaatatatttaactccttaatgagccagggatgtgggcaattcttccttattaaccaagagctaattatttacaatataaggtggtattttaatgtagccagtatatctgactacttcaaaatcttagtttaatatcaaatgaaatcaaatacctgctcttttcgaattagatgaaataatattgctgtaatgtgtccatttttctttcctcaatcttttcaagcaatataagcatataagtacattttaagcacttaaaaatgagcccaattcttgttccttggtcctttggcattttttgagggatttgtcaatatgtagagttagttagcaattctcaccatggtgtggagtgtgctctaaaacaggtagacatgatagtgatcctgtgcatcttcaagagcaatgttgtttaaagaatagttgtgtgttcactccctttttctctctatcacttgctcactagctatgttttaactatggtcattgtagttgcaggtaaatccacaagagttatttcaagttgaaggggggtgggagtatagcagtataccacaggcattcccgtggatattcaaaagtggtacagttggacctcaggaaacctagaactagcatgctagaaaccagagccacattgttcttcttttagagaccacagagtctctcatttgtgtgttgttacttgcatctgaaccctcttcttcttctctccccttttctcttgcttcctcttcccctttctctgttcatttattctgaagatttgtttgtttgctccaatatggccatttgccctgacatcaactctagtgtccaccaataatgtgcaactgtccctgtcaaattctcaagggcaaaagacagattggctcagctcagcttttagagcagagtcaccaaattataagtcaggggcaagcaagaatcgttgtctctgaggcaggtgctcatctcagaactagtcatctgtggctgggagagtgggggtggaggatgtagcacaggggtccccctttccagaaactttgagtagcacaggtcactgtggaatatgtctgttgcactcacacagaaaccttattccttcaacagctgtttagatgcagcagaactgaatattaacgtcgtagcacacccactgcaccccagcactttccttcccatctcgtttggccagtctgcagatctgcggtatcctctgtcactttactgctagctctccttttctgcaacattcagattgcttctgaacattgcatctgaacagcccaggcttctaaatatcacagatctctgtttttctatcccttttgctttcagctgtttttctttcttgctggttcttcaggctgttgtgaccaccatgtgctgtgaaatctctgtctgattctttttggagttccatagccccttggctccctaccaaagagatgtaaagattaactagttaattaggttaagctactttatgtctaaagagtgtgctagaagagtgtttctcaaactttttttttttttttttttttttgaggcagagtttcactctgttacccaggctggagtgcagtggcacgatcttggctcactgcaacctccacctcctgggctcaagcgatcctcccacttcaccctccgagaaactgggaacacaggcatggtgccaccacacctggctaatttttgtattttttgtagagatggagtttctccatgttgctcaggctggtcttgaactcctgagctcaagcgatctgcccacctcggcctcccaaagtgctgagattataggcatgagccactgcaccaactgtttttctcaaactttaaacccttttcctgtttgctccaagaatgcctggcagcggtgctcgtggctacagtgtttaccccaagataacttcgccacaaaatatctcgcttttattattttcatatctgtctagtatatggattttggaaacaaaagacataattctattcatagcattctatttttagtagtggtattttcatttacaatatatagtaattccctatcgtttaaattgtcaaatcctagaacatgaagcattcctacgcatgatgttaacatcattttggaacagttggcggaagattcatttgatgaatcagatttttccaaaatagaagattctgatgattcagatgattctgatgttagttctgtttagaaataactccaagaacagtttttatgttttcatttcacattgaaaatcagtcaaatttgcttcagcctcaaagaacatgtttatgtaaaattaaatgaggctggcagtgaggtgcactttgttttctaaacaggattaatacacataggaaacacctgggaaacttgtgaaactgcagatgagattcaggagctccataggggagctggtggtggtggtggtggtggtggtggtgatggtggtgatgctgatggaagaacaacacaaattccagtagaagactagattcagaagtgctgtgcatttattgtaaatatattctacctgataggagtgaccatgccttaggcatctttatatgcccttccatgcccagcactgtagctggtatgtgattgatatttaaatgttgattggattatgattgagctgaggacacttgaaatacaggattttctatgccatatttttaagtgagaggttttcaaaaactgctaagaaccagttaaatcaataagcatttcttaaggatctgattgtgcaaagccctgggagaaatgtaaagaaaatgttacagtccctgtcctcaaaagaacactggcatatttaccactaacttgaatatgtctatactggaattgtggaaataattgtcaaattgtagaggtacagtgaaggccagtgagcctgtttatagtcctagcaatttgacgttttataatttaggtgttattttccccatatatacataacaataatgggttctagttatgtttcagtgggataatgcatgtgaggattgggtttcataccctgcacacagtaaatgattgctagcagtagtagtagtggtagtagtaatacttaattagtcttaattatccagccagtccagtttaggaaaaactgttcccctctccctctctttgctttcttaatgttccatttcactttgtagagattatctgtagtttaatcttgatgttgttcaaagtataaacttaaacaaaaatgcattttagaatgtagttgattcccctggatatgaaaattgctgtatgctctacaacagaaagacaggaagaggaatatattttcctaccttacaactgtttaaacccaagctgtatttctccttttctctgatgttttcataaatttattcctttaaaaaaattaatgtgcttaaagtgtttctctaagtctttccagccattttggattgaccaggaaatacgtacacacacaatgcatgcatgcataaattcacaggcgaataaaaatgtatgttaaataagagcgttatctttggaaagaatgtaaattgagtatacaaggaaaggaatattgaaatcataaatagtgtcttagactttataaaggataagcatctacagaattaataacatctgtattcttcaactaataaaaccaataagcagatatactgtactctctatacaaattagaaaccagtttgtgataaatggtgaacaattcttgattgctagatcatcccatgtactccccatataaagtaggtcatcactatgaatttccatgtagagaagaaaaagttgaagtgacaaatgtatcttttaatgtagaggctatcattgaagaaatactcaggagacctctgagggaggctggcacatgagcctgtgaatcatgactattatccttgtcttagaagtactcacaaagaagaccttggaaacatttattgtcctttcactacctgggtccttttcattacctatgtaacccagatgtaacctggctgtccagctgcctggattccttcagattttccagtttgccagggtcaacttgttctttaaaatataatgtaaatggactcaaatcacaatctcatgcacagggagttcccagcatccattccagtatttttagtggttgtaagcggagttcatgtctctcctggacccctctgcctctgagttccttcttacgaatatttcagacaggaataaagaagttgaaatactccatgccgcccacataaaatttttttaaatcaaattgggtaacgcaagtgaaaacatttcagtaagtataaagcattaccgaggagagataataatcttactaaattagaaagtgagttaaagcattgggaatgctccgagggtagactcagaggaggaaaaactgaaggtaatgaaacagcatctacttgtttcatctggcgaaatatagggaaaaggatgaagtcctgacaagactttgaagtgaattagaattgtctgtaggttctaataagaaaatctatccatgaaagtttaaaaaggaacagtaaaagttatgtggttgtaagaccccaaaagactattcaacacccgaagagagagagattcctgaagttctttgaagctggttgagctgcaattacagagaacacattctcctcacctttttaaggaagcaaatccacatggccgttgtctcattttctcttctcatatctgccagatgtgttcttgaagcaatagctgcacgttaatcagctacttccacagccctggtgcgggcattgccttctttctgcttatttcttatgttacattcagtttttccaagaattcattcccagccttatttcaaaagctactctaacatgatattcacagtttcctaacacccctgatcactttatgtgctctaatcctcaaactaactacctgaatatactgtacctctaatttgggtggactggaggaaattctggttggcgaggctactttttttttctctcaagggtagaatatagttcatttatcttgaacatttttaagtatttgggagaaattttattatacagcagtagaaattttattcagacagtattgctcagaaaataatacctatcagctttaaaagaagagttaaaaggtaatttaaaacaagaaggtgttaagtatatgagacataatttggggatgtggaatcatagctggtcccagctcctctccatggaccatcagggagtggcagcccatttgttatctgcaccatgggttaccctgatatccctgcctcctttgcaaatgttaagtgtttcacaacagtgtctgactccctgaaccctaagaggtagtacacaaggcaggcagtttttgtttgaaggagattgggatggagtcctggctggacagcagtgagcaaggggatgggccctgcagttctgcaatgctgtagatagagaagaaggcaagaggagctgccaacgagaacaggcatgctgtgggagcaagccctcctccttaacattctggcccaacattgaccaagtggaggatgaacatggagtaggtactctcaggggcctattacttctgagaagtcatgacttgtggagctctgaataaaaggagaaaaggggatggcttcaggattgggtcattttcctgccccttttctgaaaggatgagccatcaatgtcaagtcatcctataagtagggagaattgcaaaggagatttttttttttttttttttgagacggagtctcgctcttgttgcccaggctggagtgcaatggcgtgatctcagctcaccacaacctctgcctctgggttcgtgtgattctcctgccttagccttccgagtagctgggattaaaagcatgtgccaccacacccagctaattttgtatttttagtagagaaggggtttctccatgttgttcaggctggtcttgaactcccgacctcaggtgatctgcccacctcagcctcccaaagtgctgggattacaggcgtgagccaccgcgcctggccgcaaaggagatttttaagatcattagcgcttagagagttcccttctcttcctgagtggagcagtggatatgtctggttacttccaacctcccaaaggttcacattgcttgtttaattttttagtcaaaatgatgtgtcatcagctggaggtcacctttcaaagtctgctcttatagcactctgtacaaaatctttatattcctagagtaattcaataattgagtcagtaattttccctattttgctgtcccaaattgaattgtgatgacatttttcaagacacaaataaggcagtgaaacctacctgtgtttcttcatcagtatctgaatttgtaaaagcatctttaggctacttgctgtcaatggaattcataattcacatgaaaaaaataagtgaccatttgaagccaatatgcataagaatgagtaaccagcatgaccactgtttttagtgcaggagtgtgttcaatattaagaccattaatgtttgcccattttatttaatcatgtgcccttcatgtggaagaatcaggtcttattgcatacagatgagtgttcaggtaatgattcaggcttcatgctatcaaaattaaattctaaaagccaagaaatttatcatttttatatccctttgcagatacagagtatgtgtagaaatatctcttgaaatatgccttgtttacgtgagaaataaaataagcagattatgttaattagaaatagtatctgagtggccaggtgcagtggctcacgcctataaacccagcactttgggaggccagggcaggtggatcacaagatcaggagatcaagaccatcctggctaacatggtgaaaccccatctctacttaaaaaaaaaaacaaaaaacaaaaaaattagctgggcatggtggtgggcatctgtagtcccagctactcaggaggctgaggcaggagaatggtgtgaacccaggaggcggaacttgcagtgagccgagatcgcaccactgcacttgagcctggatgacagagcgggactccatctcaaaaaaaaaaaagaactagtatctgagttaggcctttaataatatatttctttttaatataaaattgaggcactcacaaaaaaaaaatacctaagaatacctctggccaaggacaagaaacatctctacaaggagaactacaaaacactgctgaaagaaataatacatgacacaaacaattggaaaagcattccagctagtggattagaggaatcaatattgttcaaatggccatactacccaaagcaatctacagagtcaatgctattcctatcaaactaccaacatcatttttcatagaattagaaaaaagctattctaaaattcatatgaaacaaaaaaaaaaaaatagcctgaatagccaaagaaatcctaagcaaaaagaacgaagccagaggcatcacattacctggctttaaaatatactaaaaggctatagtaaccaaaacagcatggtactgatacaaaaacagacacatagaccaatagaataagttagaaaaccgaaaaaaaaggctacacacctacaaacatctgatcttctgcaaagctgacaagaacaaatgacagggaaaggactctctattcaataaatggtgctgggataactggctagccatatggaaaagattgaaattggaccgttccttacaccacatacaaaaattaactcaggatggattaaagacttaactgtataacctacaactataaaactccccaaagaaaacctaggaaataccattctggacataggccctggcacaatgtccatggagatttcataactatgaccccaaaagcaattgcaacaaaaacaaaaattgacaagtatcaacagagtaaacagacaactttcaaaatgggagaaaatattcacaaaccatacatctgacaaaggtctaatatccagaatgtatgaggaacgtatacaattgaacaagcaaaaaacaaataactccaccaaaatgtagacaaaaaacatgaacagatacttctcaaaagaagaattacaagcagccaacaaacatatgataaaatgctctacatcatcaatcatcagggaaatgcaaatcaaaaccacaatgaaacaccatttcacacctgtcagaatggtcattattaaaaagccaaaaaacaacagatattggcaaggtggtggagaaaagtgaatgcatgtgcactattggtgtgaatataaattacttcagaccctgtcaaaagcagtttggagatttctcagcgaacttagaacacagctctttgtcccagcaatcccattactggatatgtacccaaatgaaaataaatcgttctatcaaaaaagacacaagtacttatatgttcatcacagcactattcacaatagcaaagacatgaaatcaacccaggtgcccaacaatgctgggttggatagagaaaatgtggtacatataaaccatagaatacaatgtagccacaaaaaaaaaaaaaaatgaaatcatgtcctttgcgacagcatggatggaggccattattctaggcaaattaacataggaacaaaaaaccaaataccacgtgttttcacttataagtggaagctaagcattgggtactcttggacgtaaagatggcaacagtcactggaaactgatagatgggaaagggatggaggggggcaaggataacaaaactaacttggatattttgttcactatctgggtgatggggtcattcatgtcccaaaccttagcatcatgcaatatactcatgtaacaaacttgcacatggactcccagaacctaaaataaaggttgaagttattaaaaaaaagttaacacactattttcccaaatcagaagaatgagtgtttccctggttacttatattttggattccttctaaacaggctatgcgtgattccccctgagttgtcttcaaagtctagtgtttatggctgtatcataatctaggtttgtagatattatattttggaaaaatagaggaggtggggaaaatacttcaaaagaggcacttcttactattaaggtttcttgtaattgaaagtatagtcttgtaacttggaggtatatcccttataagaatacttcagaagcagttttagatattgagaacctgtttaacgttcctccatttgagattttcatgcaagattttatgtaaagcgcaagtggatgttatgttccataagtaaaaatttctagttatatctctaaaaccattttgccgataatttcagtattaccaaaataaataaataatctaagtttgccttggaccccactatcctatctaaactctggtaataataaatataattgtgcagtatagcttctaaatggaaaaattatcttcattttcaagagagaatagatggctcttggggaaatgtatagttaaggaataagaaaactgtcagtcattcaaaaaacaagattgtggagatgacaagagtggagccctgggaatcctcagatttgcctttaaacaataccatctctcttgtggtttccaaaggattctggagctggaaaagcaaggcaaactcacgctttcttattagctccctaatggtgatatgatccctcatcctttatttcctctgttaggaagaaaactcctcccaggaagaaaactccaaatggagagagagggaaggaaatagaaagggagagaagggagagggggtggaggggagagagcaggtagcttggcctcctcctatgcaggagcaacaatggtctctgtgaccttttaccctgaggggccagagaggtcaagagaggtccctgcagacatgatcagtcattgataggacacagtgactttgtcatcagccccatggccataaatcctgatggcattcttcttcttttgaggttaaatagaggaaggaaatagaaaggaacctggtactctccctggaatccaccaactaatttgaaacataagctgggcatgactagatcagtggttcccaaagtgtgttccagggcacattagtcctatagcatgaccatatgtctgtgtatctgtgtgtgcatgtgtgtgtgaaaaaggagaagggtttaattttcgttgaagtctagaaatgatgggttaaacaaaatttactaaatgctgtatgtgaattatttcggttaatcttgacaactaacttttgttgcagatgctattataatccttattttatttatttatttttattttattaatttttttttgagatggagtctccctctgtcacctgggctggagtgcagtggcatgatcttggatcattgcaacctctgcctcccggtttcaagcaattctccctcctcagcctcccaagtagctgggactacaggcacctgccaccacactcagctaatttttttgtatttttagtagagacggggcttcaccatgttggccaggctagtctcgaactcctgatctcaggggatctgcctgcctcggcctcccaaagtgctgggattacaggcatgaaccactgcaccccgcctataatccttattttaaagatgagagacagttcagagaagttaaaaagtatatctaaagtgactctttttttttaagatgtggtgctggatttaatagcctgatttcagagcccagatctcttgactccatgactttctgtggcctttttaaaatgaacagatatgtacccttaacttctatgagatgtatatagtgtgcatctctcaaatttatttggccataagcttttttgaagttttctgaactttacaagaggtgaatgttccagggaacctactgtgtgaagcagtgggctagatttaatcagatgttgtactcaaacaaaacttcagtttggcaaaccaaaaatctgatgttgccagcatctggatacaaagagctagtataaagtagtgatgtgatacattctgcatttagaaatatttgcgctgaaagtgtctgagttacttcttctcatttctcttccaggtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcaggtttgaaaggaactatatttgtactttggagatggaaacgctttaatggtgggaaaatgtcactgaattttttttatcaaaaagagggaagttcggctcatctttcagctctgaagccacaagttaagctatagctctccagtttctcctgcttcttggtacctctgatgtctccctttcttcagggctctgtaggttttattgttcattccaattttgtccttaagatattgatatccaagtaaatgagtcgcagccttgggagccacttcccaagctttcattaagtgaagcaataataacttgtgttctacctgtgaaatctgttcatttctctccgattctgagacttctgcacagtttaacaaacctccgcagtgctcatgagtgtgcatgcagagctctggttgtgctgacagatgtttaaaaacatgtaatcagacagctacatgagtggctacacatgtctggttacttaagagtgcaagcctttctagttcaaattggctttcactacagctcattttttccctttgaatcatacctaacagaggtttttatgatctgattctttttattattgtttttagactagagtccctcaggaattttcttaactagaagcaatagccacacacctacatacagaaaatgctctgtaaaatgttatgtgagtgactgggatattagggagcagcttaagagctgggagtagaggatccctcttgggccaatgaggaacagaagtcttcttttttctaaagttttacaagtctaaagccaaatgaatgacagtcttagaggaattcctcacgttttaagtgcttgtcaaagtttaagcaagtagcatatataaggtctctagaatagtgtctaatacatttttaggggctcagtagctacagggcgtcactctaatgtaatgcagttctagttcctgaacttgatcagttaatatgcaaaaggattttccttgtagtataaagaaaagacactcgtttgtattactttgtgggatagtttgtagcatagcagtatctagccatctcttttctaattctttctcatttagcatgcaatcattgtgttggcagaattttcttttttttctgagacagggtcttactctgtcacccagcttggagtgcagtggcatgatcttggctcacggcagcctctgcctataagattcaagcaattctccttcctcagcctcttgagtagctgggactacattcatgtgccaccatgcctggccaacttttgtattttcagtggagatggggtttcaccacattgcccaggctggtcttgaactcctgagctcaggcgatccacctgcttcagcctcccaaagtgctaggatgacaggcgtgagccaccacgcccagccgaggaatattgtttaaggttaattaattaatcttaactcctttaataaaaaatattcaatgtataaattctactttttcacgggacacagaagttatctagaagctatgcttgttttttcagttttaatactctttattttttaaattactttttaaaaatgtaacttctttctttttacatttattttaggttgagaggtatatgtgcatgtttattatgtagataaattgcatgtcacctcatgggggtttggtgtacagattatttcaccacccaggtaataagcacagtatccaataggtagtttttaagtcctcaccctcctctttccctctaccctcaagtaggccccagtgtctcttattcccgtctttgtgtctatatgtactcaatatttactcccacttattagtgagaacatgtggtatttggttttctcttcctctgttagttcacttaggataacagcctccagctccatctgtgttgctgcaaaggagatgatctcggttttttatgactgcataatattccatggtgtatatgtaccacattttctttatccagtctaccactgatgggtatttaggttgatttcatgtctttgctattgtgaatagtgctgtgattaacatatgtgtgcatgtgtcttcatggtagaacaatttctattcctttgggtacatacccagcaatgggattcctgagtcaagtagtaattctgctttgagttctttgagagacagccaaactgcatttcacaatggctgaactaatttacattcctaccagtagtgtataagcaagcattcccttttcgctacagccttgccagcatctgttattttttaactttttaatgatagccattctgactggtgtgaagtggtatctcattgtggttttgatttgcatttctctaatgattagcaatgttgggcattttcatatgcttgttggcttcttcatggcacatatgtcttcttttgaaaagtatctgttcatgtattttgcccactttttaatgggcttgtttggtttttgcctgttcatttgtttaggttcctcataggttctggatattagaccattgtgagcgcatagtttgcaaaaattttctcccattctgtaggttgcctttttactgtgttgataatttcttttgctgtgcaggagctctttagtttaattaggtcccatttcagaagctatgcttttaatcaacttgggattcatcttattaaaatgtacattcttttggggggagaatggtggtttgttttttcctctaagtgacaagatttattgttttatatataatgtaaaagtgccaatgtttgcatgttttcaataatgctaacataggggcctaacatagtgacttaattctttgaatgcctaaatcacccctgcacctcttgaatatgcttcattactgatatagtagataaaacagtaccctgattatcagaaaaagatagccctcaagcattgaatataaggcaaaagttccagcacagttgtatcttaatgagggaaccctctcttgcaataaaatgtgaatagaagcattgccctattgttgtgttacaaatttaaaaagtgtgatatttctaattcccctattcccatggcaatttattctaatagtcattatacttggacttccacagcagttttctgattggtatctctggttctactctttttcttctccatttcattatctcagatgtctacattttaaaaatataaagtggattttctcattctccagcatttcagtcaaggtttctctcattgccccaaaaaaaagtccagtccctttagcttacaagagtttccacggtctgacccaggaccatctttccattcccaagttagttactattatcctgcattctgacatgccaatctatttactttttcctaaattttcctgatattgccatctttgcttatgtaaagaaatctttactttgagctcctcctcattagttggtaaaacccacgtgctcaataagtgatatgggaaaatgtagatgagtgagagacagatgcaaggggcttatcaccttcccatattctttattagctctacaaagctttccaaaataacttcagaatctaaacaacagtgatgtgcttgacaatcacaagttaattctcctggacatcactttacttctttacagaaattctagaaactttcaatattctcccccttttgtgaagccttaggaattgcctctttatggaatcacaccaaataagaattactcattcccttctttatgcctttaaagtatttgtccctttagtcattgtagcacttatcttagaatggagtggtcacttgttttggtgtgtgtggttggtggatttccttaataaattattaattccttgagggcaggaaccatttagtattcatctctgtatccccagggccttgcagagtgcttagtggatagcaggagcataattaatgtttattaattaaatgaataaattaataatcatcaatgtaccacaaaattatataactgtaaaaatggatacccaagctaaagatagcattaagaagagaaactgtaatattatcaaagtagaaattaaatgacttaattctctgatctgtttgtaaatattcctcaaaagttattattattaggactatttttataagaaatattttttaaagctttacctctataattcccaaaactacatgttcagctttgccctcaacctgatcttttgtgtttttatattcaacatactataactcacctctacttgaatatgctccacttaactcaaattcaaaatttctttttttttcttttccagataattctttttttatttttaattatactttaagttctagggtacatgtgcacaacgtgcaggtttgttacataggtatatgtgtgccatgttggtttgctgcacccatcaactcatcatttacattaggtatttcttctatttactctaccacggagcacttgacactctctttgaaactttttgctaaaattctcttgtgctgacttgtaaaatatccagttaaggtggtactgtaaattcacgttttgccttctgccttactgtatatacagaatagccaaagaataacgtataacaaaagaatgttaaaaataccgtgggcatctctatagaacagaaatcaagcagaaacaccaaatgtactggtagactaggccaaaaccatagacctgatatctcctggggtccagaagcaggtagatgcaggacattttgttaggctcaaaatcttccatgatttctgtagaactgagctccaagctaatcactctttttgtggattaaatgtgcctgacaacagaagcaactttgcatcacatttgttcactggttataatgaatacaagtaaccatcccttacaccgtgtattttgagtgacttttttgttctcaacatcccttaatttcaaacagagttcaaataaactcagtgaaacccaaaggaatggggagaacaaagaataagcacctcataaatggaatacactcagtgctatagatgcccactgtcaaccccttccctccctgagcatggcctgggacaggacaactcggctttttgtggccctttgactgccatgaaccaaattgttgaaggtcagtggctcctaatgagaatcacttgcctcctcttcccttcagtgggtggatgtgcagtgagaatgagttatgataaaggtatgtacctgaactaaatttcaatatctcaagcagcattttaaacaaagcctgtaattttcgggcttggttttgatctctggcaacgataagcatgtctctctttttaggctcattagaatttactgactcctttctgattcatgatccagttcttatatgaggaatgattcatggatcaggagaggaaaattcatttcaatcaagaaagaaagtagatgattacaaatccccttcttctaaaaatcccacacataggtttcaatatgatatatgaaaatggaaatgtggctggatccagctagtcatgtaatgtgaacctgaggtatttagaatctcctggtactgtaatggccacatctcttacatgggagcattatttgaggatgaatgcttccatttcttcaaccttagagtgaacaacaatagtaatataaatcaatattttattattattataaaaattattgaaaactttttatagtgaatattgtaaatgctcatcccttacatcctaaagttgagtgccttttttactcttgtcgtttttaaaatttcaaatagagcaaaggaaatgaaatccaaaggaaaaagagggaaaggaaagagctcctggtaaataaaataaactgtgtttcagtctccaaagatggctgccatcagttacttttctccttttatgtaggtgctactcctcacatcaaaggatggagactagttctcatccttttacatctggactgtctttggacttgcttagaccaatgtaatgtgatggaagtgatgctttttcataatgggcctagactttaagatgaatggcagttttagattccttcctcttggaagccaccatctaagttcaattacccagagaccaccacggtggtagaaaccccacgctggccatgtgcagcagacatgtgcaaaggcaggctcagccagcctccagttgtgtcaggcaaaccagctctgattccagacatggacatgtgagtgaagaaggcttcttgtaggttccatccccaatggacaccacacagagttgaaaacctgcctagcccagattgcagaattgggagaaatagtacattattttaagtcactaagtttggtgctagcttatttgaagcagtcagtagctgaaacattctggtgtttcaatatcctcattattctcacatcaaacttgtaagtatgtcattgtccttttaaatgttactgcttgcagaaaccttcaggatttataaataaaaatgggaaaacatgatatgattttttttcctaaagcagaattggggcttctgctaaagtaaagtaaaagtgatcttacccagtaacagtatgtacttgaataggatccagaatgaccaacattacaggtttcacatgtccttggcagttagatgcctgtttgcagtctactccaagctccatttctgaaaataacattttaaaaaaacaatgccttggggcctaaggaaaaccccagcttctcactcaaccgtgaacagacactcccactcaagcttgaaaaaatctttgtgaagcacagttcactcttcccacattttgccaatagtggtgggggaaatcccacatgttaaaaacacatacatatggatgcccattctctgcttaggtttttgatctcaatcctcgaagattcatatcagaaatctctctgcctggaagatgatgtgtagtcattcagtgtttgttttcttcattattgtttctgaaaacacttaggatttgatactgctcatgaaaaactcctagaacaataacatcaggagttgcctaaggctttgcacatcatcatgaaaagtaaaaaggaaaatcatatttttgagagaaggtttaaatttctgttgaaacacccctgatttacaatgtagccaagaaggaaaaggggctgaccacttgtggcagaccgggcctttctagaactcaggtttcctggatttcttactttagtgagctgccttttaccagtctcaattggagatggatgaggacaaaggtaatccccaactctggctatttcagtactaaactattatgtttaattgacatcttttttctaggtggacagagggcatagagcatggatatgggacgggggtgagagaaagagtaaagggctggcactgcatgtaagtgcaggtgtgcatctccctttgcaccttggtggtccacatcatggttattgtcatcatcactgccacccattacgattcaccattcatcaggcactgtgttaagaatttcacgtatgttatctcagtttaatatatatatatatgtacataatatctgtacatatttatggggtacatgtgacattttgtaacatacatagaatgtgtaatgatcatgtcagggtatttgggatgtccatcaccttgaatatttatcatttcaatgtgctggggtcatttcaagttatctcttctagctattttgaaatatacaatacatgttgttaactatagtcaactagtttgctatcaaacattttatctcaatttttacatgaagcctattaagcaggtatgatttcctctagtcagacaaggaaatcaaggaaatgagaggcttagaaacgttttcacatttacagggctgctcagttgtgggattagaatcagaggttgattcacaagctctccagagctgccattgttgttcacatcaatacttctgcccttaccattttgttttcaaaactcttcttggtaatagtgacatgtaaacattaaattttaaacttagagaactctaatttcataaaagtagtattagactttacacccagctccgcacaccctgcaaaaaaaaaaaaaaaaaaaaaaacttgaagtgatcagggttggaaaattactccttcatcttctacttaatcttctgatttccaagaaagattgcccctctttatggtaccaaaacatccctagttttcctcactattctcatatgtaatgcaggtgtaataacactatttaatttcgtacagttgtgtgaaagataaaattttaattcatataagtatttagtatagttcctgaaacatactaagtcctcaatatgtgttagtatttttattagtataagaaccctttcaatatgtaattggtacagaatgcagtcagatatgtaactcctttcttctctacacttcatcaatatctctcaaatgttcccctccctttcttcatgattttgcctggtgtattagctcaggctgccatacaaaataccatagactgggtgtcctaaacaacagacatttatttgtcacagttccagagactggaagtccaagatcaaggcgtcagctgattcaggtcctggcgaggcttgcatggacattttgctctctcctctcatggatgagagagaaccctctcatgtctcttcttataaggacactaattccatcatgggggctccaccttcatgagattattacctcctgaaggcctcatctccaaataccattgcattgggagttagggcttcgacatacaaatttgggggatggaggaaacaattcagtccatagcaccttggtgatgtctcccatcatctcatccttagactattacagctgtcttgagaccaatattgttcaattcttgtctatccccattccacactgaagcattctaaaaagcaaaattggccatgtcataaaatcatctaatgacaatcattaggctatagaataaaaggaaaaaatcaggagctgggcatggtgactcacgcccgtaatcccagcactttgagaggccgaggcaggtgaatcatctgaggtcaggagttcgagaccagcctggccaacatagtgtgaaaccccgtctctacaaaaaatacaaaaattagccgggcatggtggcagacgcctgtaatcccagctacttgggaggctgaggcaggaaaatgtcttgaacccgggaggcagaggttgcagtgagccaagatcatgccattgtacttcagcctgagcaacaagagtgaaactctgtctcaaaagtaaataaataaataaaaatttaaaaaataaaataaatattcactacttctccacatagtctttaatgtcctaaccatacttaactagtgctgccacctaaaagtgatatgacttctgataaaacttgacttaaatagcacaactaaattcactgttgcttgctgagttcatcacttatggtgatgagagaggagacggaatagaattgaaactaatttccatcttgatacccatgataaataggcttcagtaaggtgttagtggaagatatgctaatgtgatacacacttaaagctaatatctgagggtaacaaagatgttgttgtttaggtgtgttgcacactctttaacccttaatgtggctggcatctcttattgacatgtgcatatcactgccatgccataccatgtttgacccagagaattaatgaaacattcccattgtttatcagttttgtattcaggctaagtaagtttcctatctatttccttgccattgttctccaaattaataataaattttaattttcctggcagatcctattttttttctgagacagagtcttactgtattgcccaggatggagtgccgtggcacaatcatagctccctgcagcttcaatctcctgggctcaagagatactcccactttgggctcccgagtagccaggactataaacacgtgctaccatgaccagctaatttttaaaattttttttacagagcatttttaaaagagcactttttaaaaaatggatgaccgaagtcttccattctactcttgggtaatgaaaatacagttaccgattttttaaaatgtatctctctaagatttgtattcagaaatagtatgtataaaacttgactagagagtagaaaaaatttttgaggctgttttatcttggaataagtatggcaacgaaagcactgtgtttctctctcaacctcgtctatgagccactttagttggtatcaacatggtgatactgtaacacactatggctctctctcccaggttcttacctgtatttccattcttggtttgcaactttttccatgtattatttgttgttattttcattatttaaagttacctctaatttatgattcagtgcctacatagttctttaaggaaatatatagtctacaatcctttgtatgatcatactttaattacatgaatcaactggtacattattaaagaggagatccggaaataaaggaaaatgggtttaccagtactagagaaacaggaagtagggaaaggtaatttggggaattagcaattgaatcataaatttctttaaaaatgaatggttagccatcattctcagcaaagtgtcgcaaggacagaaaaccaaacaccgcatgttctcactcatagatgggaattgaacaatgagaacacttggacacaggaagggggacatcacacactggggcctgtcatggggtaggggggatgggggagggatagcattaggagatatacctaatgtaaatgacgagttaatgggtgcagcacaccaacatggcacatgtatacatatgtaacaaacctgcatgttgtgcacatgtaccctagaacttaaagtataataataaaaagaaaaaaaattaatggttagcacaatacccatgatctaatgctgtactcaacagtttacatattataaaactcaagtgaatagaagaaagtgacgtttttacaatatgttgttttttgttttttgttttttgttttcagagaaaagtataccatattaaaggtgaagtgtgaatatcactgggccagaggcggtaacaaactttgatcctcacagaagtactctctcagttgctttagcataactgaaatagcctgcctcattaagtatcactttccttgcagtcagttgctaaagatcactcctctaataagatgtcagaaatatttttgttcttcacatattttgtacttcaaggccactatgtccctgcttaataatttcttttgctgggtacagtggcatgcacatatagtcccagctactcaggtggctgaggtgagatgatcactggagcccaggagttcaagactgtagtgcactgtgagtgtgcttgtgaatagccactgcattctggcttgggcaacatgagagaaataaatattgttttacaaaataatttttcctattttcgaatctgtgttttttgcttataccatcattttcctattcatgttactgtggttaccatttcttatgatcttctctcttcccaggccaccattttcctctccacatctctctgaagacaccatctttctgtccccttctgccggtttcttactcctacttgttcttcatcctcattgtaacctcccttccttccacccttagttgttcttgaaaaatacaatctggaacctcagattggaactgttaaggatattttcaccagcccccctgatttcctcactagcttggcttcctccttaagaaattttgccaatcacccaacctacagaataggagaaaaattttgcaatccacccatctgacaaagagctaatatccagaatctacaaagaacttaaacaaatttataagaaaaaaacaaacaaccccatcaaaaagtgggcaaaggatatgaacagacatttctcaaaagaagacatttatgtggccaacaggcacatgaaaaaatgctcatcatcactggtcattagagaaatgcaaatcaaaaccacagtgaaataccatctcacgccagttagaatggcgatcattaaaaagtcaggaaagaacaggtgctggagaggatgtggagaaataggaacgcttttacactgctggtgggagtgtaaattagttcaaccattgtggaagacagtgtggtgattcctcaaggatctaaaactagaaataccatttgacccagcgatcccattactgggtatatacccgaaggattataaatcatgctactatgaagacacatgcacacatatgtttattgaggcactattcacaatagcaaagacttggaaccaacccaaatgtccaacaatgatagactggattaagaaaatgtggcacatatacaccatggaatactatgcagacataaaaaaggatgagttcatgtcctttgtggggacatggatgaagctggaaaccatcattctcagcaaactatcacaaggacagaaaagcaaacaccacatgttctcacttataggtggaagttgaacaacgagaacacttggacacagggtggggaacatcacacaccggggcctgtcatgaaatggggggctgcaggaaggatagcattaggagaaatacctaatgtaaatgatgagttgatgggtgcagcaaaccaacatggcacatgtatacctatgtaacaaacctgcacgttgtgcacatgtaccctagaactttaagtacagttaaaaaatattatatatgtatacacacatatatatagaaaaaaggaaattttgccaatcaccaacccactctatgccacacagttctcttttgtcagccaattagtgctactctgtaacggatacttatttattataagtactcttaactaagccatctctgcttctgagacatcctttggattatttttaattgataagtcttaagcgatctttgaaacagattctactgccctgaagtctgtgttttatacattctatcctcactgtctagtcaagacatgaaaacaacatgctgttatctcacacgactttccttatgttctctgatcatttctctttgccgtctctcttctttgccatttttcgtttcatcttagatgagaaagtaagtagctcattctcaccaaagccagctctcccaattgtgcctttcatctgtttttcctactcttggaacttgtttcattgaattttccacaactgcctcacatcttaaatatttctctctcctgtaggtctttcttgtccatctagaaatatgtatcactttacactgcctagaagagcttactcgtaatgccgctgctttatcaaattactgccctgcctctcttctttctttaaccaacaactactcttgaagagtagttcatacaagttgcctgttctcatcaccttgtgttcacagttaagccttcagagtaccttgcttattctctttctttcatcactcataacgttggacaccaaatccactgaccactcttctcatctgcatatccttcaattcttctgtagaaatcagtactgataaccagccttccttgaaaagtccatctctcttggttttcacgacaccctattcttttacaagtattttcctgctaactcccaggtcatagccctttcttcttatgcctgaaaactctgaagtatatgtattttccagggattgcctttgcattttttatatcatagtgataattttcagatctatcaacttgagcctaacttctctctccaaatataagctcacattttcaaatgtcttttggatacattcacttgggtttctctctgatcgcttgtccttaagatgtacagatattgtcatcaactttgctcctctgccttatcctaattgctctgatctcagtgttattctttcactcctttcttttcttcttcctcttgatactttttctggttttcctaacctaaaagctagggtaatttctttcacttcatactcatactctcagatgagtggctgtcaaactaactgatcatcagaattgcttatgctttcagaaattatggtttgatgagtctcactatagacttactaaattagaatctctggtgatgaagtcccacaatctgtatatttttaagctctcttactcttttctgatttgagggtactactagagattctgtctctaaatttctgtgcctaccccttcattacattgcaggggccactcctatgccattcccctacctcaggccttcattactgagaccacagcaatccttccctaactggtgtccctgcctctagcattctctccaccaacctattttctttcctgtgagtttaagctatgtgaatatgccacacctcttctccgaaatttaaaatggcactccatttttctgtaaagtaattatgtattgtttaacctggccctcaatattccttcatgacctagtgctacaaacatctcgttactcaccttcatgggaacctttaacaccagccaaaaggaacaacttacagtaatttatgcatttgctttttgcctctctttatgctgctctcactgcctttgcctcaatatttgtatgttcaaatatggcccatcttcatggcccagccaaaattctttcttctttccccaaagttccctgataatcatcaataggaagaacctcttgttttccctgaatttttatgtaacttttataaatctctcttataatacttatctcctaccttttcttatagggtatatacaaatatatatgtaatatgcacaactatataatctttttgttgttgttttttgttttttgagacggagtctcactctgtcgcccaggctggagtacagtgcactcgacttgatcttggctcactgcaacctccgcctcccgagttcaagcgattctcctgcctcagcctcccaagtagctgagactgcaggcatgcaccactgtgcccggctaattttttttttttttttatggtagagatgggctttcaccatgttgaccaggctggtcttgcactcctgacctgaggtgatccacctgcctcggcctcccgaagtgaatgtatataatcattgagagcagatccagatgtaattcaacattttatctatcacattttatctaatacattttgatgctgaagaaatatatttcttgaataacaaacagcagccaaagtttatctggaactgttcgaagtgttccacttttcaaccaataaatcctcacaatccacaaaaccttatttgggaggcactaatagtatattcaatttacagatgaggaaattgagcctcagagcagttaagtaactaatacaaggtcacacagctagtgaaggccctcaagtagcctggttccagagtccatgcttttaatcattctgcctttttttgtgaataaattccacccagtcatattttttaacctcagtgcattttttaacatttaattggctgagggcttatattcaaaagagatctttttcttttaattgaatttgacagaggcaagctttaaattttatcataaatagccttcgagaaggcaaataatgtgatttacaattaggattcatcaacttcaaggaagaagtggaaatttgcttataggaaaaatttaaatgtgttgcatagttacataaagctctgttgtacaattttatagagactgtaaaacagaatacttataaattaataagtaattgaaataaacatcatttgattcttatactcattgaattatacaatctccaagacatgtgatttccttctccccatctttttcccccaatgccagagtatttgcaaataaatatttaatccatggttatattaaagctgctttgctaccatgaaaaaaaattttttttacaaacatctttcacagactttgtaactggacaaactccacccggtaaaaaaataagtgcatggaaacaaaacaagaatgtagcaagatctgcctagtttattaaacatgaaattgaatagtggaaatagctccatttgggaagcttaggaagcatagtgaccaaaaaactgtatggctgctcattcattagtcttaaactattaatgtcaaactcatagtacccagagttaaataagattctgatgcttctactcttaaaaagaaaaatggaagcatgtagttatgagcctggggcaaaaagaagctctaatatctaccatatatttgctaataatatcagacacacctgtgaaccagtttaaccattaacaatttaaactctacatttaaaaaagagaaaaaaaatcctagaattaaaatatcacaaaaattaaggtctacatgtaatattgacaagcaaatacagaaatcaaatttgatagtctatcattgggcacaaatcactttgatcactaatatacaagtattagacagcctctttctccctagagtatatacatagcattcaatccaggaattgccttttttttctgaacaccattgtttcccttttttttctctgtaagggcttagtccaatgttgctagtaagaatgagcaataagatattagttcactcccttatgcattaaaatccctgccacacctgtgggtattgtgccattgtttaaaagggtaataataataagcctttatataacacagatatcaaagagctttgtggtcagtcgttgttgtacatgcctaaaaacagctctgcgtgagttttgtatccatttgcttaattaaaaatataattatttaacaacagagagtaagtaatatacatacagctgttgggaaataccattatttctaagaccagacaatactttgataatctgatagctgttgggaaaagagatgcagttaatcacattaatagagagtcaaaggatttaactcaagtagaccttttagaacagtgatatggcaagggaagtaaaaaaaaaatcaaatcaaattttaaatttgtattacagttttgtgtgtgatggttagagaaccaaattaaagaaacaaaggcagctttgaagtatgttggcatttatccagattgagggtctatcagaaaatagttctgggaactgacatttatgataactcattcaaatattttcttgcacaattagggttatctttagggttaattttcctgagacatcatgccatatttgactcaagatttcagcattgaatttgagcctattaactcttaatgagtgctaactgatgtcttatcaaactatctgtaaaagataactggctattcatggccaaatacatagtcatctaatgtccaaaaattatgagaccatttagccagattcaaaatacagacataggcaagtttaaagatgcattgtacattttcattgtattacaaaagttaagtgtgttggaaaattgctgttagctgcctgagcatgcctgtagctgagttttgagctccttaatagctgagtaactggtaatgtagttagaaaactaggttaagccagtcttcagtcattagttggctgacttcatatttgttttagaactctaatcttctaagaacttgttttcataattccaccttatgaaacatttatgaaatgtgtagaaaattactacgacagctgtaaacccaaatgataattccctttcccatagtttcaataatttttttcttcactagaagaaaacagagcacttaaccttttccttaagaatcacagatctatttgatcccccctcagcaaaatattatctggcacttttgaagtacatggttcaaatagaattactctaataatagtttttgcgaggtctgtgtgggtatgtctcatctaacttggttattctccttagattcaaaattatatcctgcaaattgaaaattatatatagcttttgcaaggcaagaccataattctaggcttgtaccatttttttttcaaccccaataaatcacattcaaagtagacctgacactggactgtcttttagcatccaggagagccctaagtcagctcttgacaaagtactgcgttttaagttcccagaaaaccttgagactccactgagaatttgctcacattctcctctttaaccctggaaaatatactctaggccaatactgattcacttctctgcctgcagatctagtgtgtcacctgcacagatctttccaaatcatgcttgtatccttcacatatcagtaagggtcagggtaaatccatgtcagaaggtagtcggtggaagcctccactgtggttatgtttactgttcctacctttacctctaaagtacaagctgcttaaattaccttctaaagcaaaaatttaaaaattgtgggtcacacagtgcattgatgagtcccactgccaacctattttacatggaataggatggcatgggagagagtagagtggatgggataggataggataggataggaatcaaagtgtgtcatacattaacttgggtttcataaaagttttctttcaagattgtgtagttcacatgtaaaatgcatttctcaccgtggtttgtggtcagagtttgaaagtcagtattatacagtaaatttgacttctcaatggccctggaattgacatatgtctatggaaatcttagataaggtggattgtttctgggaagcattcaatgcttgcagcacactttttctccctccctctctttttccctcccattaaaaaacaatcccattgaagtgtctctatgggaatgttactcataggcagctttgtttacaagccacaaactcaaattttttatcaagctcctgcagcccaaaagcaattctctccctgctgtgacatccacatttctctgtgcaccttccctactctttaaagagtgaaggagatagtggggttacaatttcttgtcaattttacttttaactgtagcatgtcttgtcaattttacttttaactgtagcatgtcttcttagccagtcccataggcctttttttaattcattaaactagaatcagaaactgtcttttttaattcattaaactagtgcttgagaattatctcaatgcttctgtgagctcacattctaggagagtattaaacaataaacaactatgtaaattgtgttaggattctccatagaaacagaaccaacaagagatcacctgcagattggagactgaagaagctggtggtgtatttcaaaagcctgagaggcagaggtgaatggtgtagatttcagttttagttcgaaagcctgaaaaccgggaatgctaagggcagaagaaggaatgttccagctcaagcagtcaagcagaagaaaggtgaagctagccttcctccacctttttggttctattgaggcccttaaggtgttgggtcatgcccacttacatcagggagggccatctgcttacccagtctgcgaattaaaatgcaaatctcttttggaaacactctcacagacacactcagaaataatgtctaatcagatatctgggcttcctttaacccagtcaagttgacccataaaagtaaccatcacataaatcatatagtaagttagatgtcagtaagtgctatgaagaaactgagttagaaaagagagagtggcagggaaaatagaagatgctgagatgtccttttttttgagataaagtcttgctctgtcacccaggctggagtgcaatggtgcaatcttggctcactgcaacctctgcctcccaggttcaagcaatttcctgcctcagcctcccgaatagctgggattacaggtgcctgccaccaggctggctaatttttgtaatttttgtagagatggggtttcaccatgttggccaagctggtctcgaactcctgacctcaggtgatccacccgcctcagcctcctaaagtgctgggatcacaggtgtgagccaccatgcctggcccaagaggtccattttaagttggttagtcaggaagtttttggtgacagtttgaatgtgatagaacttcaggtctgcatgctgaaaacaatactcctcaaagtctaggcttgcacctgattacatcaggataaacaaaagggttctatagccaaacaaatatgggagattctggtatatatataaaaaacttaaacatgtttctttactatgtgatactttagaacttcaaacctacaaaggaagaaatagaatgagacaagatgagaagcagcaaggtaatgggaatggagggaaacttaggggcagagtaagaaaaataaagttggaaaactatagaagatgagagatgaagtcaattaaatagggccatggttgctctttgaaaaatactacccatatgagaacaatacaagcaacaattgcagggtatctatagccatgtgctcttttcctaacgtgactaaactgatggtggtgagaattaggatgatagtagctagtgcttattgaacatgtgcctgatgcccggccttgtgctgagtgctttgtgtgcatggtttccctctctggagtgcagatccacacaggtagaggctgcctctgccttggctcatctctttacttccagcgcttagcacagtaggtattcaataggaacatggaatttgtcttatcagcattaactaatacttaccaaattgatgcatgaattattaaaatttctacaattatcctttattttttatcaggacttacggtacagagaagttaaggagtttggctgaggcccacccaacaggctcaaaagtgatagaattggaagccagatgcagatctatctatccctcgagttcatcctcattcagaatattgccacagagcatttattttcctccatggatcatatcttaaacgactagtgtaccttagacccactgctgcaaagcaaattaacttttccctgaaatgcattctcttcattcttgtactttcgaagtccagggcttctctaaaaagaaattcaagctttcagatgaaaagagcagcagtaaaaagcagggtcatatcgacaagtcacatcaacaattcttttattgaacaaacattaagtgacttacttatgccagaccatgtgctaggcactgggaatataaagataagtaagatagactgagttagtgcacttaataaccttggtgaaagagatagacacgtaacaagtaatgacaaagagatacaggcatgaagaaatacagtgtgctcagggtgcctggaagactagagagcattcactgggaagtaggcagggactggtggtgaggtttatcttttatgatatgggaggcagttaaagggtttttagcctttaaatggcctgatcatatatgaaaatacatataaacatgaacttttaaatattcatacgtgtgtatcacgtgtatacatacgtaagttttttttttttttttttgagatagagtctcactgtgtcacccaggctggagtgcagtggtgcgatctctgctcactgcaacctcagcctctggggttcaagcaattctcctgcctcagcctcccgagtagctgggattacaggcatgcgccaccacacccagctaatttttgtatttttagtagagatggggtttcgccatgttcgccaggacagtctcgagctcctggcctccagtgatctgccagcctccacctcccaaagtgctgggattataggcatgagccactgcacccagccataattttttaaaagatgtttctctgggccgggcacagtggctcacgcctataaacccagcactttgggagactgaggcgggcggatcaccgaagtcagtagtttcagaccagcctggccaacatgataaaaccccatctctactaaaaacacaaaaattagctgggcgtggtggtgggcacgtgtcatcccagctactcgggagactgaggcaggagaattgcttgaacccaggaggcagatgttgcagtgagcaaagatcaggccactgcactccagcctaggcaacagagtgagagtccttctatgtaaaaaaaaaaaaaaaagatgtttctctggccataataggagtaggagggatgaattggaacagacagctctacctacgaagctgtcaaaataggttcactaaaagagatgaagtcctcaggaaagacaatgttctaggaaggattgtagaggacaaatttcagagcaacttagaagataaaatagacaaaatatgttgactaatttgatgcagcatatgaaggaaaatggggcatcagggtaaatcggtgcgaatggtgataccagtactcaggaggaggaaaaagtgtgatgagaagagggatactaaattcagctgtggaggaactctgtttgaagtggtttggggatctccaggcctggagcttaagagaagtgaagatgcagattcagaaagagttggccctaatgtgcttggaggaagataacattggagattattaatttaggaaggatatcttaataaaatgaagaacctggcacataataagtgttgatagagtctagcctgctgcaacaaatatttgcaaccgtatctggagacagaggccaaaggacctagagtgagtttcttattatctgaatgggttttcaagagctcttttggaagtgagttggagaactgctgaaaagacaaggaaattctaaaattagatctgagtatagaactaatgactaagggttaggaatgccagctacccaaatgaggtggagggtgtttctttgaacaatttgcaaacccagtattttttttttttttacacggggtctcactctgtcacccaggctggagtgcagtggcacagtcagctcactgaaacctccacctcccaggctcaagagagcctcctacctcagcctcctgagtagctgagactacaggcatgcgcttccacacttggctaatttttgtagtttttgtaaagacagggttttgccatgttgctcaggctgaccccagtctttaactttgttgttcactctcccatgcacagtatcctcatggtgatttggcagttctgtgaaatatgtgccttattgccttcctgtatgaccctcagtttatttgctgagaacagtgggggctgactgctgcggaactggtgttaatccttgtcaggaaacctcaaggacaccaatattttctcaccaagaaaatattcagatcacggaaacatccttgtctctaagtatctgtgaatttcagaataaagacctatgttttagaaataaggctctttgatacccttttgtttcaatctatctttctaatttaaaaataatgtgtgcctactgttggaaatagatccattaatatctttttatttaaattttttttttgaaatagtttcactcttgttgcccaggctggaatgcaatggtgcgatcttggctcaccgcaacctccacctcccaggttcgtgtcatgctcctgcctcagcctcccgagtagccaccatgcctggctaatttttgtattttaatagagatagggtttcacattgaccaggctcatctgaaactcctgacctcaggtgatccccccacctcagcctcccaaagtgctggaattacagacgtgagccactgcacttggctgatatcttaaatccacattttttcacagttgtgttctatgttttacattgatgggtttgttttagtagcacattccaaattgttagtatcagaaggtcagtgaggtaaaattaaaacaagtactttggaaggttgtaaacatagaataaatttcagcttcatgtaaatggagtgtgatttccataataaagccattattgttgtcagtggtgcatagcaataaagccaaggctgcaattacaaagaaaacagataatacaacaccatactttctttaaaaatggcagttaaattcgtggaaataatatttttcactaaaaataaagagatgtgatgtaatctcaatggaatctactaactcccatgagtagactttcttaatgatagtagcactaattgacgtatctacttgctggtttgttgtttgttgttgttgtttgttttgttttctttgcctttccagaagtaatttctttcactaaaaccttttcaaactattttggttttcacattcgtgactccttgttaatttaagtatgtaaattaagtactgtgatgatttgatttttttttctccctgcagtggaacttcatcttgacacagcctgagttacttggcatagtcttttttcttttttgttaattgtagtaaaatatacataacaaaatttagcatcttaaaccattttaagtgtacacttcagtgtcacataagtacactgacaatgttgtgcaactgtcaccactatccatgtttccagaactttttcatcactccaaacagaaactctatatccattaaacaataactcactattctgcactcctcccagcccctggtaacttctgttctactttctgcctctgaatttgcctattctaggcacctcgtgtaaatggaattattatttgtcctttcatgtctggcttgtttcacataacattttcaagggtcatccatggtgtagcatatattataattttattcctttttaagcttcagtatctcagtatgtttaggctattacagaataccctagagcaggtagcttacaaacagcaaaaatgtatttcttacagttctggagacagaaagtccaagatcaaggtgccagcagattcagtgtctggcaagggcccagatttctggtccatagatgatgccttcttggtgtgtcctcacatggtggaaggggcaggacagcaccctggggcctcttttataggtgcactaatcccattcatgagggctctactctcacaacctaatcacctccaagcagtccaaccttctaattttatcattggtgattaggtttcaacatataaagtttggggggacacaaacattcagaacgtggcactgactaatatcacattatatgcaaatagtatattttatttatctattcatctgttgatggacatttgggttgtttccaccttttggctattgtgatactgccatgaatattggtgtgcaaatatccatttgagtacctgtgccttcacttttttgaatatatacctacaagtggaattgttggatcgtatggtaactctgtgtttaacatcttgaggttctaccaaactgttttccacggcagttgtgccattttacatctctatcaggcatgcacaagggttccaattgctaaatatgctcaccaacacttactatttcttgtttttttgataataatcattctagtgggtatgaaatggtatcacggtggttttgatcttcgtttccctaatgactagtgatcctgagcattttttcatgtgattattggccatttgtatatcttctcaaaagaaatgtcctttgtccatgtttcaaatggattgaatgggtattttgttgttaagttgtaggagtcctttattttatatagcacagtcttatatagatactcatttcttgggtgcaacactgtgtttttagggcctccttttattgagaacattgaaatgattctgttttatcttcactaattcactcctaaacacaacttgtttccaatattaccaattacaaatgctttctttggtaaatattgaattatagacagcagagaagttattagtagttcatcaaatgcgaaataacagcttaggaaatataaaaccaaagtgattttcaattgaatggagcactgtttttcagtttgccaaatggaatttatagtcactgtttaacaacaacatgccccccaaccaactttcatcaccatcaccccctcccaatacctctttccttttgacttaggccctaaagagggttaaaggtgcctcctcagaggcagattaaccataaagctaacgtagcttaagtttcaggtcctttcaccagccttggccccttccaagatcctgcacctaattacggttttgtaacttttgttttttaaagaagcctccctaatataagcttcaggcccacaaaatctggatatgcctctggatatgtttcttctatctgaaatcatcatcctaatcattgttgtacttctggaaggcaagcctgggatctattaagtatgctgagttatttatgactagctttttccttacggagtttctagtctggggtgccaaactactatacttttctgcagaattccaggaaaatataagccatggacattctcatgagccccagtatgctcccttagcttctccactaagctctgtcagcacataccactcgctttgctctaagcacttagatgaacatgcaggccaaactttgaaaattggttcctagttgttcatacaaaatgtgcatgtccctttgtactccgcccagagccataaatagaattttgttcttacacagtggaagaaaagaatgcagttgccagacttgatacctaatctttgaaaattttgtgagcacagcttaggggttttctaaatattagggtatcttgtcagaagtaaaaatgagccttctggccctttagcaaattatattatttcattaaataaaaatgaatttttctaaaaattaaataaatcttaatgtatattttcttgtcctgctgcaaagcattagtgacaaagaaattattcatctacgtaaatcttcttgtattagtcttactttccctgtacagttataataataattttgacaatttgtatatattgtgatgaagggcatatatcagcacggtcccttctaaagccttatttctctctcaaaaaaaaaaaaagtgttcgggttccctttctcctcaccacttcctttctccctctttgcctcctctccttgttctttctttttcctccctttcccgaacaattccatctacagccaccaggtagtacagagcaaggtgtgcatctgcaggaaggggcccaagcctcggtgtcagaagccaatcgttgtgaggaaggaatccatgtgaggggtgcagtgctgcccagctggaattgtgggacactgagtgagtttgggaggccacctgagcgagggaatgggtaacagcaataggaagttggttacatgcaggggagtggatcgaatcagtagatatattaagaataataagcaatagcggggtgcggtggctcacgcctgtaatcccagcatttcgagaggccgaggtgggcagatcacctgagtccaggagttcaagaataatgagaagtagatctcttaccaacacagaaaagttacaaatatggaaagggagaaaactggaattaaccccgtgatgttgggttggaattagaagcattgaaatgaactaatgaatttcaatatatagagatagatagagtaaaacagatctaaatgtgtttgtgtgtgcatatgcatgtgtatcctctatctactaagagagcttaggagcagcaacagcagtgaccatacctagccccagatcacagtttctaaataccattctcccctaaaagaaaccaggactggggcagagaatatttgaaacatcttgggccaaaaagcaaacaactgctagtagaatgatgaggatataaccaaagtcacagaaaccatcttgaaagggctcctgctagggacaacttggcatcgaaataaacaatgatagtggccgggtaccatggcttataccagtaatcccagcactttgggaggccaaggcatgcggatcgcttgagcccggaagttcaagaccagccggggcaacatggcgaaaccccatctatacaaaaagtacaaaaattaagtgggcgtggtggcatgcgcctatagtttcagctacttgggaggctgagaggtggcaggatggcttgagcccaggaggtcaagcctgcagtgagctgtgacaacaccaccacactccagtctgggcaatggagaaagactttgtatgaccctatgtgaaagaaaaggagaggaaaaagaaaagagaaagaaaacaaaaaaggaaagaaggaagcagggagggaggaaggaaggatggaaggaaggaaggaaggggaaaagaaagaataatggataatatgctaaataagcaggaatatattagtctacattagaagataaataagtggataaatcaaacatttgataaggaaaaagatatttacatagtttcaaagaaatgccacatataaaacttcttaattacacaggggaaaatgctaactttacagtgaagaatttgtgcagccatcatcttaatcaagtgaccaaaatgaacatcttcagtaacgggaaaaattgagttcttgcgtcaccttatagaatgctgtaagatgaactcagcatcccttctgtgatttctaacggcttataatctaaatctaatcacgagaaaaatcaaataaactcaaatttaaggacactgcaagaaaaactggctggtaatcatcaaaagtgtcagggttacaaaagtcaaggacacacagaagacccatttgggattaagaatctacgaagacgtgtcaactatacacgactggatctctggatctctctgctaaaaaggaaattactggtataataaaatggaatctgagaatgatagtactatatcagtgttaatttcctaatttgatggcatcatgtttatgtaggaaaatgtctttgtagaaaatacacattattcagagggtaatgggggatcagattcacaattttcaattaattcagggaaaaaaaaactttctcattgtactctacttgcacgtcttctgtatgtttgagattgtttccaagtaaaattaaatttgaaaattgctaaagttgtaagcaactgtttaaatttccatagtggacgaggattttaggtgttaattgatgatagtgggtaaagaagggctttgaggtctgtcatgaaagttgtcagtggtgtggtctaccctgatgtctttcaacagcttgaaaatgtgtttatttgtggctgcaaagatccgattcactttctaaatcttatataacttgtcacttaaatattaagatcgcctctatatggttattattctaaaactcagatagcaaagaaaactcaaaatagacaagtggaaagggtaataaagtcccttggccctgagaaaatctattctgaaaacgtctgaaacaaactgcattagaacatgtgtagaataagtttagttgatcattatgaatcagtcacttcatctttgctcttaaacttaccaataaattttggtgtcttctcagtcagaaaaaagatgtgagtacaggtttttccaacacacacacacgtgcgcatgcacacacacacacacgcacacacgcacgatgttatataatttctgttcttaagtgcctggttggaatatgctaatttcgggagcacactactgcctgccattttctggtggaacagtcttttaaggagatttctacaaatccattgttgctttgtggtacttactgaacagtccagcaggtggtagtctaggagaggaacagttctcatcctcccccagccatccctgggcctaccagcagccccatttgcaaaacagaatgtggactcagcaatgtgccttctcccctctggcataagaatgggatttccaaggttgttctctcaaaatgggcactagaataccacagaaagaagccaaaaataactgtgtatacatgtgactgtgcagtattctgaagctcaaaaattcttttttttttatttctagaaattccactgattttatatctctttgctctgatttccgtgacatggctttggggaggactacacatggcctacagacacttctggatgttggttctctttgtcattttcaacagtctgcaggtaagccttacaatttggttagtgacaacatacatttatcttaatgaacacaaggcatagaatttcaatattaaagagtcaagcatccacacacaggtgaatttgtgtacataataacatcatatagagttgtaaaataaaatgataggaacctaaatccttaacatttgaaatatgactgggattctaacttgctcattatacaattagggaagacaaaatatttattctccttcattttgaacatcgaagtaactacacaaacatatttctttttcagtaggattgatgtttatcaactttgcaaatggcagtcatgtaagatcaatgcacatatttggattgtggctgggtctagaaattagatcaattgaggagtgaaatagtgatgttcaagcagtcccctcttaagtgtgatgcttagtgaaatgagagtgtttggttcactaaaacatgactgacatcccctaagtccagcagtgcccagcttaaattagttttataagcatgcttggataactagaaattatataactgcagcaaaaatgaaagctgagatttttagtacttttgttaaatggaaaaatgttgcaccctgatattaacaaatggaacaaatgaacacattttccttgttttccaaagtgaaacgatctgtcctagactaaaagaatttcttaaatttattaaattatctctaaatagtccttcttttggctaccatcttgcaaggatcatgtgtggcaaacacacagacatatacacaccttcagaattgtagcatacaattgaaatgtgactccagtcattttttaggtttgcacctgagcagacaaactcttcagttagatcatagcttacatgatggtgcctaatcaaggacattatcaacttaggaaggggaaaatacaaaacaattaaaagtttagaaccaagttgctacaagtttctatatagacaactgtctgtggttatagttacaggtgagcacttactattgccaggtggtaaagaagacagtccggcctctctgggatctgatgattcaaagagtgaacaatcagctctaagaatctagtatggcaggtgccatgtaaagagagcattttgagagtgagtaggggcctgttgaccatcagggcagagccatcagggcagaggctcagtcttggtcacctttagatccctagggcctagtggaactaagaacaaggtccaaactgacagcctgcaggtgtgttttgcttggcagacacacagtgttatatgaaagattgttttagattttcaaatagttgcttcaaacttttaaaattgagaattttcacattaaaaacctgaattgctggctttttttgaaggcagtatttgcatggcagcaatttccaagccctgagcagacctgatatacttcattcattttacttgcccctgagattatgacacatttaatgcttattaaataataaatgagtgtatggttagagatgggaatttcaggcagagaaaactgttagccaaggctgcaagaagggaaaatgactaatctcgcctagattaagcaacgtgttgagaaggaaaaagaaaggtcttgcaattagagaagaagttgtaggagaggagacagaaagggtagattggtttaaacgccggctttccatgcttgggatgctgagcttcaatctttaagcaaggggaagccatcgaagttgtgatttttctttgtattgttctaatttttttaattttgtcaattaatttttttttcattttgaatgggatgacatgtttgtactggaaagataactggaaatgtttaggagaggatattgaaaaaaagagcagctctaagtaggtaggttattgttatatttcagactgtagatgttctggcagtgtgcctgggaataaaaagtaggtgacaggtttgacagttgttacagagataaacacttttcattttattgtttaattgacacataataattgtatatttatgggtacatagtgacgtattgatacatataacatgtagtgatcagattaaaagaattagcatatctatcatctcaaacattcatcattactttgtgttgggaagtttcaatatcctccttctagcactttgaaactataaaatattgttaactatagtcatcctgtagtgctatagaacacaagaacttacttcttctatctagctgtaattttatatcttttaacaaatctctccctatcccctttttccccctacccttcccagcttctagtaccctctgttctactttttacttctatgagatcaacattttttagcttccacacatgagtgagagcatgcaatgtctaactttctgttcttgggttatttcacttaccataatgtcctccagttccatctatgttgccataaataatattgggttgatgcaaaaataattgtgatttttgtcattaaaagtaatggcaaaaactgcagttacatttgcaccaaccttttcttttctttcttttcttttctttttttttttttttttgagacagagtctcactctgtcacccaggctggaatgcagtggcgcgaactcagctcactgcaacctccacttcaggctcaagtgatcctcccaccttagcctcccacgtagctgggactacaggcacatgccaccatgcctggctaattttgtttgtttgtttgtttgttttgtagagacagggtttcgccatgtttcccaggctgctcttgaactcctgaactcaagcaatccactcatcttggcctcccaaagtgctgggattataggcatgagccaccgcacccagctgtcattcttttttatggctgaatagtattccattgtgtgaatttaccattttccctgtccattcattggttgttggacacctaggttgattccacatcttggctattgcaaatagtgcagcaacaaacatgggtgtgcagatgtctcttcaatacactgattttctttccttaggataaatgctcagtagtgggatggctggatcatatgtagttctattggcaattttttttacgaacctccatactgttctccatagtggttgtactagtttatattcccaccagcggtgtagaagagttctgttttctccgcatcatcactagcatttattttttgtctttttgatgatagtcatcctaactggggtgagatgataattcactgtggttttgttttgcatttccctgatgattagtgatgctgagcatttgttcatatatttgttggtcatttgtataactgttcagatcatttgcctgttttattcagattgcttttgctgttgaaatgtttgagttccttgtatgttctgcatattaattatctgtcagatgaatagtttacagatattttctctcatcttctaggttgtgttttttactttgttaattgtttcctgctgtgcagaggctttttagtttgacataatcccatttgtttatgaaataagcattttataaatgctttagaacattggtctagggaaagattttataaataagaatctttagatttttataattttataaatagattcttattatatttataaaccttttatttatatttaatagcctgtaaaatcttttatttatatttaatatccttttatatttataaaccttttataaatatgaatctatttataaaattataaagtgaagcatttcaccttgttttcttccagtaattttatagttttgggtcttacatttaggtctttgatccattttgagttggtttttgtatagggtgagagttgggggtctagattttttcttttgcatgtggacatccaggtttcctagcgacctttattgaagagactttcctttccccaattaatgttctagctgccttctgtcaaaaatcagttggctgtagataatgtggattaattttgtgcttctctattctgttccattggtccatgtgtctttgtttatgccaataccatgctgttttggttactatagctttgtagtatattttgaattctgatagtacaatgccttcagctttgttcttttgcttaggattgctttagttatttgaggtcttttgtgattccacacaaattttaagattttattttatatttctatttctgagaagaatgtcattggtattttgataggaattgcatcaactctgtagattgctttggctagtatggttcttttaacaatattaattcttctgacccatgaggagcatgagataactattaatgaaatttggttaaccaattaaatataggaaggtaaagtgtgacagaggaacatcacttagaaattcctggtttgaatgaatggctgggcactgacatctttagtccaaatggagatcacataaatagcaaggtctagggaataagcagtgaagttggtgaaatttaggagacgttgctaaatactgtataccaatgttttagcaactgggtacagagataaggctaatgaaagaaattgttaatgagtgatcagagagctaggaagagaacctggatagggtttgcagttgcgggtagaaaagaaagctcaagaggacgcaatgcctaactctggctagtgtagcagagaagttaaataggatgagaactgaggagcaatgcggtctacagctgtggttcccaaaccgttatgtgtagcagaattccatggggagcttgttaaaacacagatgataggccccacacccagagtttctgatacagtaggtctgggtggaatctgatcatttgcatttctaataagtttccaggtggtactgattcggctggtctgggaactacagtttgagaaaaaaaagtgaaatagagactgcaaagagagaaagaaatagcttaggaagggaggttggttggttcaaaggagattttttggttttgttttctcgtgacaagaaccaacaaaggagaaattgacatctggaggaaagatttgttgccatggcaagatcatggacgaggcaggaagaacagaagagatagagggcttctctgagggaggagtaggaatgtttcgttttgttttgtttttgtttttgtttttgtttttgtttttgtttttctctgaggctggggaaagaaaaaatgattggtgaacatgaaaaactactctggagctgaaagtgtggaatgttggcatttgcatgtaatgccctctcttttctcttaaaggcaagaggcaaggtcatttgttgagaggaatgggttcaaagcatgagataaaaattttaaaaaggtatggagcagtttctagacagaacagaaataacttaaactatgttgaaagatcatcaagaaatggattgcttagagagaaatcagtgggatccaatggagattagacaacttaaatctgtaattgagccagtcagcagtaattaaataaatataagccttaggattataatgatagcctgggtaacctatcaaatcacataaacaggaaaagtttattgagctcttatggaggtttgtaaagaaaggaggactgtgacacataatagtatatgtcactggtacatataagaaaaaattttggtctctttctttgaagaacttattagaagctaagaataagtaaaaactaaaaatattttaaactcatgtttaatgagcttaattcaatccaggtgacattactgaagcagcaatgattatttgtactactgttggttgttacctggcgcactggcacattcctggtaccagatgcttagtgaatcagtcctaaaagtaatgcctattaagaaacacttggaaaatatcctttctctggagtttattttggttcatttaacttaaaaatcgcttgaggtattcagtttaggcatttccatggaatatggctacatagtattaacagtaagattttttaagtatgttccataaacacttgtttgtttttttaccccccgaatggctttcatatttctctactgattttatcaacacctgtgaccataaaagcatattatgtatcttatacttgcttactacattttgctcagaggagattactgacttactttttatctagattattatgatgtcataggtgctctaaaactatgattgaaagggatggtatttgtatagtattctgatcattttaagttttttaaaaaatatttttaaacacacattctagaatctgagatctcaggatctctagccacctctgtcctctttctctacagtcttttttttcctttgagacagggtctcgttgtttctcccaagctggagggcaacgacgtgatcatagctcattgcagccttgaactcctgggctcaagcaatcctgcctcatccccacaagtagctgaactacaggcacataccaccatgcctggctatttttttatttttatttttttgtagagacaaggtttcactatgttgcctggactggtcttgaactcctggcctcgagtgatcctcccacctcagcctcccaaagtgctgggattataggcatgagccactatgtgtagcctgattttttgatatttagtgtctgatgcactttaagtaagaaaatcttgatcacttaaaatattatctaaaatatttacctaaaatttatcacttcctaaaatttcaaaggtgaactaccaaacttacaatacatttgcacatttaggaaaatgtatgtgtaatattttgcaaagcattatggatacaaatgcaaatgtaaggtttaaaaatcatcattctaaatgtttactgttaatttttattgttgaatactcttctttaaacgataaggacttcttctcgcccaagaactgaacttttactcaaattcttattggtctatccttattatttacattttcttgatagtttaaaaaattaaactgttggatatcaagagtgagcagaacatagagaatgaaggtgaaaatgccctttcagtttattcaatcagaattgtttcctaattccagtagctactatataacatgtgagcatgatcatgataattgtgtttttgccacttccccatgatgtgaggttaacaaatcctgattttcactgtgctttattttatgtcaaaagagggactctgacttcaagagagaagaaaagtacttttgtacttacatgcctactgagcccagattccaaaggccttggggttctatgtttccttaacactgaatgggctttccaagtgcattgatcatggtggctgccacggtgcaagactcacctcctgccagctttccagccccagcaggaaaaagcttattcctagataacaaaatcctatggaagaccagatggtaccatcctgggtcacatcccatgcaggaacaaatcacagggtaacagatactctggccaggcctgggtcatgaacagcatccaataatggaaagagtcaagttggtttcataaaaaaccacatggagtggaattcctgccagaagaaaggattctctgaccaacagaagggggcaacagtgcttggcaggccaaagtaacagacgtccactatacttactttctaaatttgcttgttcattgatataagtttgaacaaggccaatgacagcttctgtcacaaaactaggaaactttatcagtgtgatttcagtttattagaatagtacttgtgatctatcatataaccaaatgtctctatattgtccacaagaaattcataagaaactatgtttaatattttttattttcccgttccattaatccaataacctctattttaaaaaaattgagttgagtttgtcatttctaaggggattcatgctaatacttataggtcataagtttcttaaactattcaggccaaggtatatccaaatttatatcatcatttattggtaataatcacctggggtttatactcagctggtaggccctggcagaaccctatcagttaaaatattgaaaatagctactgtccaaaccttgcaggtgttccaggcttccatccactgaggttagaagcatctctaggcttcctgacagggatcctccaggatgctagtgcagcgctagacctgcagccattctgattgggcaatgcttatgccacactcattattaaatattttgcatatcactcctagctctaattatgtgctgaaatattctttttaacctgaaccagtcagattcaggctgaaatacagcatttatttcaggttttcttctaggagttctctcacacttactgtgttagaattttactgacaattttctcacatgtagagagaatcccatgtaagataatgagagtagccagcagtaatagacatgagctgcttggagatgctagaaaatacgtttgtggagaaggttcatatgcatagaagctttccaaaatctgaaacgcattcttcttggaatgcttaacctggcaagtgagcagagctttgcacagtgttgggatatgacacttctcagtatgtcagttatgagactgcattctccagagtactgtttgactgtttctctgtgactgacttgtacatgttcgtttgtacaagcatctggtctcgagatgttccctggcacgttttgaatcattccctatttcagagaggggagttacaacatggaatttgtagctaaaaatatatagtccatcttcagacttaaagagccagttggttaaaatcattttcattcctatccccatgtcttaagctgctaaatggttgggaaataagtgattgaaagatagcaacagtttcttccacctgttttttaaaaattgtcctttggtggtcactagagtgtcttaaacacataaaacatttctcttatttaaaataacaaacagttctctctctctcactcgctctcttactctccaccccaccctgccttttaccctttcttttcttgttttctatgtgtctctcgttgctatatgttgaatttcagttttaaaattaaagccatcttttatgaagagattttcccaaatgaaaatagtttttgaggtatcgtaagaaatggaacgtatttctttgctcatagaaaatatagattccatcccaaatggaatattggatcaaattaataatcccccttcaattcccacttagtatccagaagggttcagtgcaggtgtctgcttagatacagtacatatttagtcttggctgcttccttttgaggataaacagctcttgggaaatacacattgttaaataatcagttacagaggactaattgtttcaaggcactccctttgcagttgctttccaacagccaacagtaataagaaatgtcactttgtttccattggagactagcacatgaactattcatgaagagcggaaaagcagtcttcccagaaaaccctggaataaacatgtagaagccaagggaggctgggactctatcattgatttgtcccagagccatgtcaaattcagtgaaaaaaaaatcactacatttgttttctagagtgagaattcagagagactaatgaatgcctcatgcacctttcaaaacatccccaaaggtttctataacttcacaaataaatatatagaagctgagacaaggaggtgtacttaaattttcttaatcaggttatgcctctctgccccgtgttcagtagcatctgggctggtgaaacacctctgtgtttttgagcaacaagctaactccatttcacaatgagtgacagtgtctgacattgcctgctcattagcctgttgattgaccaggcatagttctttagatagactgcaggattttcacttttgtttcatctggattctctaaataaaagtgtcaaggtctgatctgccagtaaacatcttccacaaatatagttttagtaatgaggggcttgaacagactataccttttcatacctggctccctccttccaaacaggtgcctccatttcttctgctctaattcgtgctatcttttaatcttttaggtttttttcctgtgatttttccattttctgagcattctatgatcacatttattgcatcttaaacaatgtgttaataacatgcttttcctgggctctgtgagcctttactttgcctgcaaaaagatctagcacactccaatacttgaaagagcaaacctacaagatttaaactaaacaagatgcgtacgtcctctttaagagagtttgggagagcaaagcaaatgacatttgggactcgtttttacctggtcattcagattctttgtcttcatgttaactgataattttttccaggatctaaaactttattcttctctctcatattactcaaatgttggggtggggagaatacattttttaaaaaaaaactttatatgaatattttacaccaacattttgtaacgttcagccatcagatttagtagaaggtgcatgcagttaagtgtcaagcaacctctattttaccaagcaacgtgagttatccgcttttcagaggtgctgattttgcctctaaattttgtcctaaggattgtgtaaaaatatatgtgtataaataaaatctgtaaactatgcaatattttacaaatgcaaatcattatagatgaataaatgagcaaaaagaagtgtttatctcaggatatatataaagaaaactgagaggccaaagagctgagactgtaaacctagtctttgactcttctcctatggcataggctctccccatgaatgttcgcattcacccacaggtatttccttcgtgcagatcctgtagctcctctgtaactaccatcacattccttggtttgcagtatagatctgttgtatgtcattcacctgctttcagatatgtaccaaatgcctttaggctcaagcaggtaacttctatggctgaaatatgcttattgtgagactatagggatcagtggggactgcaaaagaactggagaactcacactcctcctaaaagcactcaaatgcaaatgaaaaaagcaaacactgtgcaggccaagcaaaagctgttgcaggcgaaatttccatggatggcagtcagtgtgcaatctcaggataagttcaaatttttccctcttaagagaatttaatttcttttggaaggcaaattgaatataggcagaccaccttgatccagtagaaaatgggtgtccacagctcaaagattaccttcccattgaggccttcctttacctcctctaagagagtcagttgttccataattatagtccctcagtatattctgtatatattcctaataaatcctagcatattgtatgattagaaaaagaaataggctgggtgcagtggctcatgcctataatcccagcactttgggaggccgaggtgggtggattccctgaggtcaggaactcgagaccaacctggccaacatggtgaaaccccatctctactagaaatataaaaattaactaggcatgctggcatgtgcctttagtcccagctactcaggaggctgaggcaggagaattgcttgaacccgggaggcagaggttgcagtgagccgagatcacgtcactttactccagcctgggcaacagagcgagactgcatctcaaaaaaagagaaaaaaaatgccaggtgcagtggctcacgcctgtaatcccagcactttgggaagccaaggcaggcagatcatgtggtcaggagtttgagaccagcctggccgacatagtgaaaccccatctctactaaaaatacaaaaaaattagctgagcatggtggcaggaggctgtaatcccagctacttgagaggctgaggcaggagaatcacttgaacttgggaggcagaggttgcagtgagctgagattgcaccactgcactccagcctaggcaacagtgagagacttcgtctcaaaaacacacaaccacacagaaagatggctgggtgcagtgggtcaagcctgtaatcccagcactttgggaagctgaggtgggtggatcacctgaggtcaggagttcgagaccagcttggccaacatggtgaaaccccatctctaccaaaaatacaaaaattagctgggtgtggtggcacacgcctgtaattgcagctactcagaaggctgaggcaggagaatttcttgaacccaggaagcggaggttgcagtgagccaagatcacaccactgcactccagcctcggcaacagagcaactctgtcaaaagaaagaaagggaaggagggagggagggaggaagggaaggaaatgggtttcaggccatgtgaaggttaaccaatctatttatagttttctctctcttgagacaaagtggaaatttgttgaggggacccaggactccagtgaaagcctattgtgttttgtagaaacctcccctccttgtctctgaactccattttttcattccccaatactatgagactcttgaattcattactgagcttcttagcttctgagcagctgctttctgcttagtccccatagcctttcctctcatgcacaggcagcttcagaagtggaacatgctgtcatttcctttttctttggaatcgtggcccctcaagtcttggctgccttggaggacttgaactctgttgtttgtctccccaaccctgtcagattcctgcaaatcccaggctgcaattttctgttcagcttctaggcatctcactgtaaactagaaagtccctcagaagaaaaaacaacgctgaatatagggctccccaataaatgggttttgcttctctccaggatcttggcccttcaactactggctgttttgaatactctctgatgcctttcaactcattttgttattgttcttgttcttgtgttattggttttgttcatgctcctatttttgttattgtgtaagtgtgtgtaaaaacatttttctccagtttacatagttgtactcaatgaggttaatctgatatacactactccatcagagccagcaacaaaaatctcaatacatttatttcaacaaattatatctaataattgttaacatatactgattgcctactaataaatgaagatacttagaggtgctgaaattcatcagatatttagtggataccttttaaggcatatactcctgggccggcatcctaagaacatcatgatgaggaagcctgtgcatgcaacatcttatggtcagctgatgaactgtactttttctcatatatcaccaaaactaaaacaataaatatggaagttgagtaagatcttagaatctgtaatccatcaattgaagattgagcttcagaaatgatatttcagcttcagaatgaccacacctatctcacaaaactgaaataaaacaatagggaaaacagactggccaggtgcagtggcttatgcccataatcccagcactttgggaggccaaggtgggcagatcacttgaggtcaggagctcgaggccagtctggctaacatggtgaaaccccatggctactaaaaatacaaaaattagctggacatggtggtgggcacctgtaatcccagctacttgggaggctgaggcagaagaatcgcttgaacactggaggcggaggtggcagtgagctgagatcatgccattgtactccagcctgggtgacagagtgagcttccatctaaaacaacaacaacaacaacaacaacagactaataacacaaagggcaactacaactaaaggtacttgcgccaaatggatagcactccaggaaacagatctgccttctcagaatatggatagaaaaatgtcaactacagttctactgaaaaaaatataaagagcatgaattcaaatataaactgaactttcttcttaaactctttagatagataggtctgggaagttttattttcagtcctgcagaataaaccaattccatgtcaccattttcctctgcaaatattttaaataatgttctctttactttgagaaatggcatgaaatagcaaattgaaaataccttgaaatacaaatcctgtcttattaatttttagttttgtgattgtaggcaaattatgtaatttctctgaaatgaggatagcactacttactttacaaggcacctatggaaatcaaccaaagaatgtgaaatttccagcacttaactggtgtgtattaacattaactgcctttctcttgtccctaatatgataccatacatgcatatgtgtttcatgtaagattacttcacatagtgtatcattgaaatcagttagcagtgttttctctaattcccttcagttagtctgattattcggtctcttcagaagcccaatgatgtcacaggctgcatttactaagctaccaactcagtgatcttatttgtaaataagacctcaatgtatgggtgctatataaatgtgaagtagacataaaatctgcctgttatatttgtcctttgttccataattaatgttttgggacatgttgggccagtaccatactgtcagtcttggaaactctcagttataaagtggtaatatagtcaagcattgcaaaaagggggccactaccctaggtggataatatttaatttggcatgtgatacttaggaagaaaattggtaaaatcaggattggctcattaccttcataaagaattttcaggaagttttgtttgcatgttgattgctagaatagggagtacgcagaggagtactatgcagagtcacctatcaggaatacaattattagctaagactaaataatagtaggtaagaagtaggtgaagtggaatgttaagatggtcatttaaaaaggtttgcaagaaaaatctaatatgtaagcatttgaggaaaacaaaagaatttgaattcatcagagtattcctcatagcacaattgattatcaaattttatagtaaaatttttatttggaaaatttgtaatgtcaaaaatataaagtaaattatacatagtttattgtttgaaccaatatcataacactggaaatcttatatttatttatttattcattcattcagaaacattaatctatccagactatgttcatgtatgtatttgtagactggttattctatgccctcaatatatattataataaaaatcagaacaagaacaataatattgattaagtgtttattatgtggaattgtacttatttcattaaatctttgcgacaacctgaatggtagggacttttattcctgccattttacacatggagaaacaaagtcttagagacttttaggcaaggtcacatacccaataacatatgagcagggattctataatcagtttcttcatcatgcactgcaacgctgaaagaagagtaccttttgtattatattggaaacctcagttttgccttttactaaaaccatttactcaaatactacactgaaaataattgaataactgtacaataaatagcaactcaagagacacaaataatcacttcatagttaaatgctaaactgatgatactgacaataattccctatcacttactctgggtatcattgggaaagttactcagtttctgtaagcctcaggttccctcttcaaaaagtgagaataataatagaacccaccttaggactaggactgttgagaggactgagtagtataaataatacatgtgaagcatggccatgtgtgcaaagcaggaacagtgctcagaaaatattagctactcttattgtcagggtggtggttgctatctagtgttatttgtaattattcttagcaataataataatttgataagttcacaggaatatctagaaaagtcagagatggctttaggaaagatgtggtccttagccaggctgtaaatgttaccaaatttggatgagtctagaggcaaaggaagtctcttcaggttcttcatatagaagtcatgaatgggaaaatgtacaaggtggggagagcatagttatccttgtctggctggaatgaagcttatgataggagaataaagggaaatactgttgaaaaggccttgggggagggggatggtcacatgagcaaagtctttgtgccacgctattatgggatctatttaaacagtttaaagtaattggcaaaaaaaaaaacttccaaaaaaattattttttgtaaataccataaccactgcaattattgaattctggccttttgcattctatctataaagacaagtccaaagacagccaccagggagtttattccgctggaggacagaaccattatcacggatgcttttgctccttccactgatactgactctgagaatgagctcagagcagcatgaaaggaatttaacataaataaataatacataaatgcataaaacacaaactgtaatccagagtgtgatcttcttgagatcaggggccatgatttaaaaatctcccatgcctctcatagttgtaacacctcttacagtgctaagaacctactgaattgaattcctcgagcactttttttttaagacactgaacaaatgagcactgaagtgaaagaactttatctaatccttaaggcatagagaatggcaccagtcaggggccctctgaacttggcactgcttgtatctctgtgaactcataggggattctctttttcttttcctgtctccatctctgtttcatcaactagaacttatcattttcttctcctttcaacatctgttttctattgcatcccattgttttcatttttcatctatcttgatcattctcatacattcacagctctgttagtaatcccacagataactatgtatgacttgttctctgagagagcaagcctttagcatacaaggactcaactctgctttgaaaaatcaaacaagtttttaaatccacctaatagtattcatcagggaattttttttatttttagagacatggtgaattttccaattcagtaagagcaaaaagaaataataaaacacccagatttgtgccatttcagaatgccagtgcacattcctagtggcagttaatactggcaggtgctgtgaggaatcatacataggcaactgggttcctgaagtcagccaagagttgattgcttatgtttttagagctgtgcgaagaagaaaaatgtaggcacaccactgctgtgcagtccacgggagtcttacagctgcaggccctgaagcactttgaaaatcgtccctaattgtcttttgcctctgtgttaccaacttatcgcctacccccatggtggctttcatgctgtgtgtcaccaaaagctagcctctgctattttctaaggaaggaactggcagctgttccaaagatgaaatctaaatgtaatctccatagttgcaggtagaagcaaagtaaatgttttagaacttttcttatcttgacttcaggcatcatacctcatatttatcaactttgtagccaactttagggcaaacattaagaaataaaaaaccacacacatccacttctcctttggccctcaaaagtctctccattggcatgactttgtatctttatattggcaaatacttggctcaattatagaagttatagatcttcctcactagcacaagtcttttccagcccaaacagctattggatttgcagacagaaggacagcagagactgcagcactttggctttgcttggcctttcggacccttttggcaaaggaaaatggttcttactagtgagtgcctatccagccttaggcagctcacaggcaagtagaaaaagtgtagaaaaggtgagactagtaagaacaaaatcttgctagagagctactgacaagaacatagcacttacaccaggtgatcacttggatactcagggtgattacaccagacgctgcaaactcctttgtctacaaaggctggaagcagactcgcctggagcacgtggtcaagtgggactgtgtcttgtaaagagggatgaagggagataaaggggcaacagctatgtggcttcggttaaacatttgctggacaggaagcagatccagtgtcagccagatcttctgatttttctagagaagccagaaaccagattttttatgtgaaacctcctaatttgtgaatggtggcaagtatttaagacaacttttaaacactatgtgggccagtcacaaactgtcggcaggcagtattcaagctgccagtttgtggcctctggcttacctaataggcattccctcatagtccatgtggatcaggaaaaagaaatttttccagctttgtctatcttttacaaattttctacactgaacattttttttttctaatcagagttgttttcagagcttttggaccccttttctgaacatagtctggaacaaaccccagctcccagggtggcctcaggatgatccatccccttgagtgacctcaagtccatagctgatctgagaagagaggagggagagtctggacattcggggcctgttctagactagtacaaaacactgggctccacctggctcagtactacagatgcaggggaggcaaaaagtcactcattctaagtcaggccagaacctctttagctgtgcttggcaatgtggagtatagctgtacagaagggaatgagatgctgtgggagacagaagagatatgaaagtatagaatggggccaggcactatggctcacgcctgtaatcccagcactttgggaggccaaggtgggcgggtcacttgaggttaggagttcgagaccagcctggccaacatggtaaaaccccatttctactaaaaatacaaaaattagcctggcatggtagcagacacctgtaatcccagctactcgggaggctgaggtaggagaatcgcttcaaccctggaagaggaggctgcagtgagccaagatcatgccattgcactctaggccgggcaacagaataagactctggctcaaaaaataaataaaaaaggaaagtacagagtagaatggggagtataggggaacactatttatttctagtcctcaactataagtaagaaaaataaatcaaaagtagaggtgctaaatcatgagaccatgggagatgctcattgctcctttctaacttgttccatgaatgcacccgtccttgtaccacactattggaaatcttcaccacaaccagaagccgtgccaggggtgcagtggctaggatggagacaacaggctatttttgttccaagtgaaacagtaggccaagtgaacaggtaaatacatggggcaactcaaaagggatgtcaacccccggagctgatgggtgtgtttcttctttatggtgtgagagtcgggccagaagtctgggtaaccaagtcaggacctgcagtttgggcaagattcgagctgcggttcagaaccacagcattggagacaaaagcaagtcctgcatgtccagtgtcatctgggccttgtggttttttcctttcttcctttttataatggattttttttttcccagagagaagatgacatcagccaaatatgagatacaggctcaagtaattaaatattttttggtttatttacttgtgattttaaaagaatatgaagcatgcttgggagacatttgtgtctggaaagagttgagcaactctaaagccgtagcatgcagcaattggtgaaaaattgctaaattatgtttcttttttttccgtgaaatgtcaaatgttgttcttttgcttctataaaggtcagtatggtttaaagagaagaaaaaaaaaacaaacttggaccattaacttgttattgaacttcaaaagtgttgtatttaccagtaaaaataaatctaaaaatgttttggtggctctgaaacaagaaagactagattgtaatcaaattagtgaatttctggtactttcctcttctttctgggtctttccgtgaaaaacaacaaggagaaaactaattcaacagcaaaagttgtttataaatactctatatgttgcttatttgtggagtatgagttaccacactaggtgagtggggtgtcataattttcccctcatgcttttctgccctttgatgttcttgaacaagaatatagctgtggaaatataattcttttaacgaatacatttcacagtggcatttcccaaatggtaacaagggacttactccttcagcagaaaagtcatctcctttttataactgatgatgtacttgtatacacacaaacacacataaagaaaagcagaaagtcctatttgttcaagtttattttctaatagccattgttatttattagcactctctgctctagtcatagcacattactacttcatacctctttttgggaaaattattttgggggaaaaaataaaatagcattacttaacagtgtgaagccataagtttttattggattgtatcttataatcttatttcaaaggcagagggtaggctggcaaaatgtaggccaggaaatgattattgttgtccctgacagaacacatactagtgacattttcaaaatagaatatgcaaaagtttatctttagtagctctgcacccaactgccaatgtttttctctttctcttgccccctctccgctactctctagcttgtgttcttttgctgagcttggcttactctcagttaatccctgctaaagatttcacactgctagtgtcagatgtgcttcctgccaggatactggcattttaaagagggactcctagacttcctgcctgtttctcctactcctggagcgaaagtgaacatacaaaaatcaatttcccctggtcatcctttttccatggcattaggaagcacagcctctccaccatgctcctggattcaaatcctggctctgctacttgctagtcctatgatcatgggccagttacttaacatccttgtgtctcagtttccttatctgtaaagtgaaaaagatgattatctcacagggttgttgggagactgaatgagataatatatgtaaaacatgtaaaagagtggctatacgtaataaatacccagtaactgttcattattatgttattattctgtcttagtccattcaggttgctctagcaaatataagggtaatttataaacaatagaaacttatagctcatagttctggaggctgggacgtccaagatcaaagtgccagcagatttggtatctagtgagggcctgtttctcgtagatggtgccttctctgtgtcctcacatggcagaagagcaaagggaaaagggggctaacaagctccctcaggccattttatatcagcactaatcccattgatgagggtagagccctcatgacctaatcacctcctaaggccccaccttttaataccaccacaatggggattaggtttcaacatgaattttggaggcaattgccaaaccatggcaattcccaacattaccatccttgttttataaatctcgttttctgaattgacttataattacttctccattccctgagctaagtatttattgtattagagccagaagatgcttcatttaaatcagttaattaatttatctattctgttgcaggaactgttgtatgtgctttggctaaatcacaaaatagacaaaatatctgtctgttagcaaaacatgcaaaaatgcctgcccttgagaaatgtatatcctagcagggagtggagggtgggtgaggtagagacaatagatagataattcaaataaacatgactagattatgtagcatgttagaagatgataaattccaagtccaggagagcgaagggcaggccagtgggatgcattttaaataggtggccaaggagaaggccttgaaacgtttgagaaggccattaatgagcacgggtagaaggaagccagggagagtctcagtgtccgtcttcagttgcttttacttcctttcatgattcacatagttatttttaaacttttttactgagtagaatttttttgtgtgtattaattctgagtaccattattcattacagtgagttccatcacattactagtaccacaaagataatatctttgagactaaaccttttgggctattttttgtcctttatcctaaaattttctattgtgtttattatctggtatatttgaatttatctctccaaaatcaccacaaaataaaatttttaaatgtttgtcttgtttttctctcaccattaagtggggttaatattaggttcattaggtaaggtttaattttaaattgtggccatctgatattgctacatcaaaaggaagttaaaatttgcttgcctaacatcacttaccaatgtagttgtactgtgagcaaaaatagaacaaaaatagtttatctggagattgaaaattcccagtattgactttagcatgactgcaaaaaactcataaccctctagtgaagacccctgaagttaacataatgaaggatagaaaaaaatgacagatgggacaaaagcaaacttcctggtaaaatgtggaagtattcctcaaaaaaggctgttcataataaacttgggtattttagttacggggtcagaaagaaaaattttagattgatttatttagttcagagaaattacatgaaaatataaaactgtaaacttttctataatgctctcttttatttgagcttgtatgattttttctaattaatttctaaagacattttaactattgaatactaaaatgaactatcacttcaaaagtgagatttaagagtctctagaactatactgtttgtatttataagacagaggagaagggataagagagagagccaaagacagtcccttggagacttggggtttcagcaactgtgccacggggcagtgcagacctccgagtgaccaggttttcagtccaggatcttcaagactatctgcagtaaagccagcagagtggacagaggggaagtcacacactgcctttctttcgtcttcctattgcatgtattctcaacactcaggacttgcctcccctgaatggatgagagtggagaagcacagaggttgacatcccctaaacttgtacgagagtcttttaaactctgctgctgacatggcgtacaaacagtggtctctaaaagtgcatttcattcactttgggtaggtcatgcattataatatcatttccccccaaaagtagctattactattacttccttgaaagggccaggaatatacttggaagatacagtgagagctacagtctggagcatcacagcacagagctgttgcctgatccctgaaagtacattgacaatccctaaggtccatagagaatccaggcgacactagtcttgggcaaatcacagcatagagttagacttggaatcagacaggcctaagtttgaattccagttagagtgccatccctaaatcccagtaaatgaaataacacataatatgcttagcccagtgcttgccacacagtaaacactcagtaaagggtagctttattatttttttcaaaggaataaaggagaagagttgcacggccttaaataattctccaaatttattttgagtgaatgcattttgtgctagagcttttcattggtaaccagatcaacagagcttagaaagcactattttgaggtatatcagatgaaatgaacacatgcagtgattatgttcatatttgatacagagggatcttatttcattgtcgtcttccttctaccatgctatatccatctgtagttctgttttcctttttaaatgtttcaaaccttacctttctttggaatccagctttaaatggactacttccttgaagctttccatgcccactctagtttatagtaacatcttctgatgcaacccccacctcattgcattccatattttcactcatttggcacctcatcatacattgcctggggcagttccctaaccagttccctgaagacccactctcttggttcttttgtactgcctgtaaagcttaattacagagctggcacagagttcccagtaaattcttgttgaattaaatctcttatttgaaatttccaatgcctccactccccttccacaaattctctcaatgtagggaaatctctttagatgactaaccggtgttaacacctcaacccaaactgacattttcaaattatttagatgcttcataattttccagtgtgttctaccaaaacaatgtttacatgaaaagaatataattattcaacatttttcctaagactatggtaaaagccagcagcattgccccacttagaggagctaaaatagctaaaggttacatgctttgcctcaaataatagacttagtgaagagggtagaagtagaaatgaggtcagccccccagagcagtctggtggccttgagcaaccaggaaggtaaagccggtacctcagttaaatcaccaagtttactggaagtgcatatttttcatgtgccaaattcagtaagtcatggagcaaatgtttattttgctatgctttaaaaagttgctttgcttcttgtaagttttctcagtggaagggttccaagttatgacttaatctatgtttgcagcattgcactggaaacaggatttgtctgtgaaatggctctgtcatttgtggaccacttctgtagggagattgtggatttaggaagggcagaagcaacagcagatatgcctggtgtttgaatggatgtgcctctctcggaggcagcaagcagcatacccatattataaagtttttgattttctaacatctgaagacaggcatccagccttgcagaacagccaggtgtctgttctatagactacagttccttgtttccagaattacggtaaccaaataatacacaaggtcacctgattgcacttcccaacaacctgaacaaagagcacctttgcgcttgctggtaggtgctgtaccagactctttgtaatctgccttaggtcagagaagaacaagccattaccagtatgggagtccatccctagtcagggctagttgctattatcccttgaatactctgcaggcatcccacaagacatttgagacttcatatttgtcaaataatagaaatctggctggcctagtggctcatgcctgtaatcctaaccctttgggaggctgatgtgggcagattgcttgaggccaggagtttgagacccacctgggcaacacagtgacatgttgtctctacaaaaaatttaaaaattaactaggcatggtagtgtgcctatagtcccagctactccagaggctgaggcaggaagatcccttgagcccagtaattcaaggctacagttagctctgatcctgccactgcactcctgtcttggtaaaggagctaaacccagtctcaccaaaaaaaaaaaaaaaaaatcttactagagatttgggttattacaaaagggatcacttaaagactttatgtcttagagacatatttcttcagctggataaacagtccatataatcatacagtagacaaagcaaaaggaagatcttagtgacagcttaaatccaggataagaaattaggaagctgcctttatagagacaccagtacttgccctgaaccattttaattctcctctgttttcataatacaaatttgggatgttttcaaattcaacagaccagcagtgctgttgattcataacctaaacaagcttgttaaccctttccaaaataaagtcactctgcttcttgaactcactagaggtgtgctagttttacaagtcttcagagtttattatgttccctggaagtgtgcctctttgtgttaaatctaatcgctctggttagtattttaattttaaacaatcaacagccttgtcctcaaaagcaaaatgaaagaaagcaagcctttggacatgttgtctgatctgcttgcaacctgtctcccaatgccctcccctccctctctctgcctcctgcctagctttctgcttgtctttttaaactctccaaagtcaaatctttcaagggagcttctctcttgggccccaattacccctagatttattgtctctgaactcctgcaatataatattttccccttatcgcagcatttatgtatagacagtccctgacttagaatgacttaagatttttcaactttatgatgggtttatcagagtagcaaatgcatttggatttacaatattttcaactaaaaatgggtttattgagatgtagccccatcataagtctagaaacatctgtaatgtaattatttttgtctttccctcactgaactagccacttgaagacaggtgctatgcgtttaacctctgtgttccaaccctaacaatgcttgttctcagtaaatgtttaatgattgaatggatccctggatgaataaatacttggatgaatgctaagaaaaatgaaaggcttattgtacctttccaacatgttgacttatgttggcacatcctaaattcaaatgacttctctaccaccaccatccccatacacaccctggaaaaaatagtaatagcatgggtggcagggggagggggcaggtaattctactgtccttgcagcaagctaataatggccacattaattccagaatggtctatcctgtgttcccaatacttagcacttgaatcatcatcattgttcactctcaggcaaatcaggcaggacaggattcactgggaaataaatgctctttttaagttcctggaggattattatagaatacagtgaggcaaagattctttaatgttggaaaaatgaaacagtacctctgtaattaaagccaaaagccgtagtgtaaatgaggaaaaatggtaatcagcctaagctaggaaaaacctcggttcaaaatacttaattttctctgttctaagaaatcaatgcatacttgtgggtgttttaagatcaaaatgatttagaatgttttcctatggcatttatgagttagaacagagagttagaactatctctgaaattcatttcctttctttgtaaacaaatatggttaacatttactagaggtgttcattcttctctaacacatatgattttgatgtatgttgcgagaacagcaaaaatcattattaaacatctacttttaaattttctccccactgtgattatcatgcaggccatgagcaggctaaattagaaagcattttggaaaaggaagagttctcccctgcctgtgagttctataattacttgcccttattgtattcaccactagtttaatgatgggtagggtatagtactgtttgttggttttctctcaagtatattttaaagtctgcctttattttgggcgacatcatagatcaaagtttgatcctcagttttacaggctcaaaaacaacttcatttcaacaatactgtgcagaaaactgaccactattcaagtattcatgatgtattaatttacgatggaatttatgcttggctgaagaaatggattagttgtctacagaaaagtaaaattcaaaggttgaagcttctttgtgatatactccaagaggagacagaatataagttctgcaactatgttgttcttttcaactattaaaaaaaatcaaattttaatgctagaaatactttatttgacatgatccagtctacggcacaccttgattctgcagaagaggaaattggaaccctgagtttttaacactatttagtgtcagagctgagactggagttcaactgagactagagtctgagagaacacagatctccattcaagaaatacccttcttatgtagtcataattgtaataagaaaagaaaaaaatttttaagaaatactcttcttagacattggcctgtttgagagatctgtgtacttctcataacccttgctgcctccctgattttggagtgggattggtggtcagaagttggaactacagataatccaaattttttagtgactgtaaaacaaaatatgaaaaaaatgctctgtaaaattggagaaaaattaaataggaaaaaagggatatttccattcagctaaagtcatctgataacatccctttctctccactttgggagagaaactggtatatttctaaattgaaaaaaaaaaaagaggccaggcacggtggctcatgcctgtaatcccagcactttgggaagctgaggtgggtggatcacttgaggtcaggagttcaagactagcctggccaacttggtgaaaccctgtctctactaaaaatataaaaattagccgggcgtggtggtgggcagctctacttgggaggctgaggcaggagaattgcttgagcccgggaggcagaggttgcagtgagccgagattgtgccattgcactccagcctgggtgacaagagtgaaactccatctcaaaaaaaaaaaaaaaaaaaaagtcttgatgtcttgaataggagacatcaaaacataaagtatctgggttactggttactgaaaaggaatctgaatgacagactcttttcattttttaaattttagattcagtgggtacatgtgcaggtttgttgcatggatttattgcatgatgctggggtttgggcttctaattatcctgtccctcaagtagtgaacatagtgccctataagtagtttttcaactttaccccttcatccttcccccttttgggatcaccagtgtttatccccatccttgtgtccatgtgtagtcaaagttagttccacttataagcgaggacatgcggtatttgattctgtttctctattaatttggttaagatagtggcctccagctgcacctgtgttgccacaaaggatgtgatttccattttttatggctgcatagtattccgtggtatatatgtaccacatttttcttatccaatccaccattgatgggaacctgtgttgattccatgtctttggcattgtgaatagtgctgtgataataatatgaatgcagatgtctttttggtagaacaatttattttcctttgggcttatacccagtaatgggatggctggatagaataataattctatttttggttatttgagaaatctccaaactgctttccacagggactgaactaatttgcattctcgccaacgtatataaaaattcccttttctctacaaccttaccaacagctgttattttctgacattttaagattggtatgagatgatatctcattatggtttttatttgtgtctctgatgagtaatgatgttgagcattgtttcatatgtttgttgactgcttgtatgtcttcttttgaagtgtctgtttgggttttttttttttttttggtttttctttttgttgttgttgctgttttgagatggagtctcactctgttgcccaagctggagtacagtggcatgatctcggctcactgtaacctctgccttctgggttcaggggattctccctccacaaccttgccagtagctgggattacaggcatgagccaccatgcccggcctttgtgcaatttttaatggggttgtctgtttgtttttctgttgatttgtttaagttacttatagattctggacattagtcctttgtcagatggatagtttgcaaatattttctcccattctgtaggttgtctgtttcctctgttgatagattcttttgctatataaaagccctttagtttaattaggtcccaattgtcgatttttgtttttgttacgtttgcttttgaggacttagtcataaattccttgagtagcccaatgtctaagaagggtatttcctaagttttcttctaggatttttgtagtttgggagttttacatgtaaatctttaatccactttgagttaacttttgtatatggtgagagttaggagtccagtttcattctcctggatatggctatccaattttcctagcaccatttattgaatagatatgcttccccattgtttatttttgtcaactttgtcaaaggtcagttgattgtaggtgtgcaactttattttgggggtctctgttctgttccattggcatgacagattcttgactctcactggctacctaaatgatcatttgtcattagtttactggatttttttctgtatagaacaaattgttgaatttattttaactatttatattaaaaatcaaaaatcaatgtggctttaattagaaggtccttggaatttttttataaatttgatttttattgttatcctcatcactaatacatttacaaatcacattttaggtatttctgaaaagatttcaacaagtatcttctctcatcatttattcattcgaaggtattcattacatagatgactgcattaagttctgagggtacaatggagaaccaaacaggaatggtcccaaacagaatgcataaaatcacagaggttgcattttactgtgggaggaagatttgaataaaataatcacacaaatattgttataaactgtgataagttctacaagagaacagtatggggtgttgtgaatgcgtaatcagaagaatgccgtctaattgggggaattcctgaggaagtgaaatcagatggctgatgaggtggcaccaggcccaggagggactctccattcaagaatagtgttccagccaaagggagcagcatgtaagggggagagggcagcacctgcaagataaatattcatggaatgactgagttaatgaatgtgcaaaggcactgaggtggagactggaaatcagatgagtggagctagatatggacagtgaaggaggggtaatgatgaccttgaaaaagtgggcagaattcaggtcatgcagaggcctgtaagacaagctaagatttaggtctttatcttgaaagtagtggtaatcattaaagtgttataggtagtgaagttgcatcttctattatggagaattattataggagaggaggggaagagactagggagtgagctgatagtgagatttttgtccaagtgaaggtgtgatatcatggtgttttctttttcttaacttttattttaggtttaggggtacgtgtgcaggtttgttatataggtagcaaagacttaaatgattattgtgttttcaactaacatattagcaatgtacttgaagagaagttggaggttcaagagataattctgaggtgatattgactagacttggtgatagattggacttggggccaggggaggagagagaaggggtcaccctaggtggcctgggccatcctggtgactcagtatctatagatgattcatctggcactctcctgctccagtaatgccacctctagtactcacatctctggtcccaccctggactttgccactgtcctaagctactcactgctgaaatagaagggaactacaaatatccttgtgcttccagccacctcacatccaggtttctgagcttgctaaggagaaccatgtacttgaagaagttactgaccctctctgaaggctcctaggatgaaggatggtaattcctaccttattagactgttggaagatgtggacgacaatgttacaaagactctgatatagtgtgtggcacatacataaacgcaatgagatagaaatcacctttcctctttcatgtgctggttcttatatcttaaacttttgcgaatcccactaactttgatttgctactgccataagtatgtttttaattcaggacttaatttgtcaggattttatacagaagttgccccatcacacagtgtattaaagaaatgtatttatcattaattaggcaataactgtgcttttagtaccaagagggtgcccttttcaaaaagtgtagctatgcttttaaaaaaaaaggtaaatcctcagtatgccactgacttcagttccataaactaataatttaataaaatgaaaatgacccaactactactatatcaagcctattaatttcacacatgtgtaaaatctgtaaggaagaggaaatagcatgtaaactggaaagataagtgtcttgattcttcaagggaagaaaagtaggcaagtacagagaactctgtttcttctgggtcatatgttttaaaggaatgacctgctgtttctttcttttttttttttttaaagacagagtcacattctgtcacctcggctggagtgcagtggcctgatcatcgctcactgcagcctcaacctcccacgctcaagcaatcatctcacctcagcatcccaggtagctgggattataggcatgcaccactacgcctggctaactttttgtatgttttgtaaagacagggtttcaccatgttgcccatgctggcctcactacaaggctgaagtgatccccaccctgccagcctggacctcccaaagtgctcagattatagacgtgagccactgcgcccaactgcctactgcttctttgtgctcagactttgctattattgacaaatcatataaaggatcacaatcatccttttgccatggggaggaatatatagattcactatttttcactaaagatctgtaaataaatattaatgaattatttttattaattgtacaaacatttcctcatacaaacctagaatgtttccttatgttaagattactttttcagagaatatgaagattttatttctttgtcttataaatcccaaagttttatttgttctaaaaattacaatctatattagactaattttataaaaatatgttctcttataagagtggtgaaatttaaagtcaaggtataaataactctctgcatgaaagacatgcaaaactacctaaaggaaaccaaaattggaaatttgggatttaattttttaattttagaaaattttctttttcttgggaggccaaggtgggcagatcacttgaggtcaggagtttgagactagcctggccaacatggtgaaaccccgtctctacaagaaaaacaaaaattagctgggcatttggcacacacctgtaattccagctacttgggaggctgaggcaggagaatcgcttgaaccagaaggagaggttgcagtgaaccaagatcgtgccactgcactccagcctgggagacagagtgagactccatctcaaaaaaaaaaaaaaaaggaaaatttaatttttctacatagacatttccttgtgtactaaaattaaaattattttaacccaataaagtagtaaaatttggcatgcttttacatacattcccgggggctttaaacatgcacacgcatacatacatacacacagaattcagcttttgttgcctttcctataacatgcctttcatcccttccaactataggtgtttttaggcccagcctataaaatctgattacataccttcataccctcacttacttgggatctgagtcataggagcagcttgcaaagaaagcatcccaatttaagtatttcaaaatttctggaaagatgtattaatggcatagatgatacatttcgacccatttcttagttaagagtgagcttttaattcatagaagctgttcctgtagggaatctggtttttcctgcccttgttttctaggccccaggcaatacaggcttttctggagttcatatattcactcatctacccaacaactatttatgaaaaacttgctatttgcagggcaccatgctgggctacgacattgcagaaatccagttttcttgcttagagaagttgatggatgatgatgtgacattagggtagagcataataaggactgtgaacagggattgtgcagggtatagtattgggttacctaacccagtatggggtggtggggaggccagagaagcatctccacaccgtggaggaagttgatacttaactgataagtaggattagcaggtagtcagggaagagcagcagagggaaccacaagtccacggggcaaacctgaggagaagcacagcacatcttgaggaattgaaagtatggctggttcagtatgcttggagtggggaatctgaggcagcgggtggccttgttcagtatgcctgtagtggagaatctgaggcagggagtggtggcagatgaagcccaaactacagaggtcttattagccaaattacaaaattctgttctctattctgaaggtattagggaaccactgaaacattaacacctcccccattgccccctaccattttctgaaatgactcaataaagaataaaccttattggtgaatcaaaagaggtgccagtgccttaaggaaggtggtcaagaattgtatttagacctacacttaaggcagaacagcaccttggttcacattctctaccagttctgggaaagaagtggttcttagccaggtaaaatattcaaccacgaagatcctgcttggccttgtaatgttatgttatttctcagaagacagccttgtggcaggccacctcaactggtaggaatgtgctgtacaaagaaatcaatcaaccaggttaaggatgagatcaactttgtgcaaattcttttagtagtaaaaacaacaatatcacctttctttataaatttgatctacagcttacaaatatatatagtacattttatttgagatgcataaaaatccatggaagtaattggtattgaaattcctatttcccagatttaaaaaactgaggttcatataaataaaatgtagttacacataatgataattagcaagcagcagagctgagattcattccaagatatcagactttaaaccaccctgttctttacaagagactggctattttcaatgaagaaaattaagcttggggctggactaaaatctttatttggatttttttttgtcaaattaccgattacaagaattgatcactccatttcctttagaagtagaaataatagtcattttgctgattttctttattatagtctaagaaaaagaaatgctctgtttaaaaatgtactttttaaaacaaggttgatttgaggtcatggcaattaaaagtggcactaccagaaactgagctatgaaaaattggctatgcaataaatatgtatatgaaattcttgttttcccttttcttttatccttttttcttttctttttttttcactgtgaccttgaactcctgggctcaaacgatcctcctgcctcagcctcccaaagtactgagaatacaagcttgagccactgtacccagccctttgttttccattcgactttcatcacaagatgggtgacacaggacctcacctaaaacttacttgctcttgataaagttgaaaattttctgttgggaaagtaattcgggagtgtggacccacatcatggcaggcattctaggccacaggacttaactgtgttcatatgcctcatatttttaactgcctcatattgtaactgagttaggcttcatatgcctcgtattttaactgagtgtagctctatgaagcaggtaccatatattttacatccttttatgtgttcacagagtttccaatatagtagacactcaaaaacttttaaagaatagtatacaacattattttgttgaggaaagattaaaatatttggaaggacttccctaaatttaggcaaagccttcacttggacccatcttccactttactgttttcctgttcaagcagtggtctgagattcagggatcagaggaactcctggtagaattccaatcattagactacatgagtggccatgaaacactttggaggcaagaccaagcctgttctgttcactgcctgcatggagcctacagtgcattaccaggtggacacttagctattagtatttactcagtgaatgaaccaaagatgattaagagagaacttaaattgctggctggttagaatctggatttacgtaaggataaagttgctagtcctgctgtatcaaataggatggcttctacaatgctggtcccttggcaagcaattactagtttgccatataattcactgtcgttgccggttgagtgaaatggggtgatgctaataaaaatgctgagacaacaggctaacccaagaatcccactcaaaccaggactgtcacaagcaaaccaggatctgaggttaccctagtgattgcccaaccataaatccaacttcagctcttattccaaaaaagtgcttacatgtgaaagcatctcgttacataattaatgggttggagaaaaaaaaaaaaccttctgtagaaattgtaattttacaaaagtttatatccaagctggagtggttatttctgagtgctaaaatttgatatcaattttggggggcttctctgtattttctttctttcttgtttctccttctgcaataaatacgaacttggtttccttttcaatttttatttttttaagttaaaacatctattgagtcttagtgttttgctaataaatcaatgattctatagaacatccttagagaactcctaggtcccttgtttcactgataagaaaatagcaacaaaaagatattgaatgatttgtctctactaaaccgtcatcagaaaagagtattcgaaaataataacataatcttttgacagtatatatgctggaattattacaatatttatttctgtttagatgctatattatctcaaagccataaatgcaaaaattccaagaagtatgatacctcaaggaatatttatctgctagtgagacttcccagaattcgtcattttgccaattttattggtaaacttttttttttttttttttaaatggagactcactctgttacctgggctggaatgcagtggcaccatctcggctcactgcaacctccacctcctgggttcaagcaattcttgtgcctcagcttcccgagtaactgggattacaggtgtgtgccaccacacccagctaattttgtgtttttagtagagacagggtttcaccatgttggccaggctggtcacgaactcctgacctcaagtgatccaccccccttggcctcccaaagtgctgggattacaggcgtgagccaccgcgcccactgtattggtaaacttcttatctcttcagggcatagtttacacctatgtctttcggtaccgcaaagcatagcacgagaagttgcacatttctgtaagagtctacgtggactatatcattgtcttagaatggagtcacatgagaatgtttctaaaacaagaccatttaggtcacctttgatacgaagttccattataatgaagtcaataatatatttaaagtttttgagtttttttcctgttatttgcagcataaaagatttagaagcccagtatatatgtatctttggcaaactgactcccttcagccacttgtgggacaagaataagtcaggaatacaaaaatcgggtatctctagaagggacattggtgtgagataaggcatctcatttgcaggaaagcacaccaccctagtcttgcattgcagagaatgtgaagtttgcagtgtgcattcagtatttctcttcaaatggaacacctgattcagtttgtagtttaaagagatttaattgtgtgctatatagtcttttgctctgaataaggaaaataatgattgaagtggatgggttagaaggagtaacatgtagttatcatgtagttatcaaactggctgatttaatggaccaagtcagattattcccctaacctgacacctttttttgacactagtacatgttacatagttcagcctgttctcaccactctctctattgtaattgtggtttttttccagagacatcagttacttctgaaatgaacaaatgcctctttctctttctccttgatgtctgttttgacaatgtggaccacctcattctctgggaacaaaatcttcccttggcttccctgatatagttgtggctgtccttaatctgacttgcctgaccagtcagttgttccttgtttacttcactggttcttcttcctgttcatgtcctccagctgtgtttaatcctgagcactcagctttttttctctataaagtgtcttctttaaaaagtcatacacccatgtggcttcagctttcaccactacacagctattttctacactcacattctaaccttgccttctctcttcatcttcagtggggtacttaacacatctcacatattttcacctcaaacatgtatgaaatttaatttagcttctacagcaaagtgatcccttctcctcccttattattattggaatggggtcatcaaattttcccctttcatcatcatcaatactgttctttggtcacctatcactggccaattaaacttatccatacaatgagaaagatatctgaatgctaaactcttaaggccttgttttcaaaaaggtaattaaaggacactgaccaaaactatgtttaagactacttataacaagatttaaataaataatcttatttattacagcacaatttggtatttttgtaattttttaaaaaaattcctattgaaagacaataccaactcaattcttttctccagtttttattaaaactttttaaaaaattatccttggatgccaaaccttttctatattattaagtcccacctcaataccatttgaccacctccaatcttctctacccctcaatccaaccacccagatttgtacttcggaaagtttttaaatctgggaaactatccaagcagggttagtggggtgagggagtttggattcttgtaatctgttaaaaacttacttttcagttccttctttcttgtcagaaatagtctggctcctgataagtcctatcatgactgattagcgttccatgctttgaaacttaacagaatcatgaagaacactgagagtctcagagacaaagcactgtaaaataggctcaaaaggaaaggctgaagaacagggatcagattatctggaaatgagattactgaagcatgtcctaatacttaccttttcacttatgggtatttaccactaagagactctaacctaatgtttcttatgtccataagtgacacacagagaaatatgttcttaaattccagatagaaaccttggtgtataaaaagaagaataccttgatgtatactggatatttataatttaaaaactacaaaattgttgttcctaggaattgcaaaatttagaatagacatctgtccaaaccttaaaagtgaaggcctgctgcctagatatttaatgatagacatgtctgaatcctgcagacttcttttattatctctactagttttgaatagtgtcccctaaattattaagtaattatagaagaatttgacaaacccatggtgaatactagttaattacttaaaccatgcaaatattttaaaaagcatttgagcaataattgcttacacagatttccaagtatttcagttgtactaacctatagctatcaagatgaactcacttgtttcctttttccatatatttaatacacagttagattgtggattcttattataaataagaccatcaacaaaagcaatattgtaaataagaccatcaacaaaagcaattttaaatgaaaaaaactaagagtagtttttaaagatgaagcaattagagattaaatgcctactcttcacatacctgaaaaatatacaaatgcagaaatactgtatatatttgttttttcaattctgtcactggcacaatatccgttatctttgctgctaagtcattggtgatgcaaaacagcagtaggtcagcagcccaagagctgtttgaagccagaaacaagagatcacaaagacttcccaggggtgtctgccaaggggacagcaaaagcaacaagccctctaaggagatgtagccacaggaaggagcatggcagtatgcaaacccggtttcagcagaaaagccagagacagccaggatgtcacctgagggctcagcacaaagtgaccataccgccaggaagacaccaacccagaaaagcattgacctggccaggaagggatgcttcattctgccatgaagccgtggcacatgttacatgttgcaacagaaagactaagctgaaacaaaagtagtattgaacaactactgaaatacctagctatagtggtgatagaattagaggactgaaaccaacacatccctcagacccatgactgtctctaccccttcctactctgtccctctgatgaaattaaaagctataattccttatttaacaaatatttcctaagctcctcctgcatgccagggaccatactataaacaaaaataaataaataaaacagtgaactggacatggtctcttactttctaggaggttacagcttaaaggaaggtcttccttttttaattccaaatttgtaatttttgagatgaagagagcataatttgaatggagatttcattcctctgagtccctcataccacattgtctcaggaatccacactgatttcgagaactcatctgaaacctgaagatgtccctcaactaggagttgttgaaccttggagaacttgtaaaaaggtctcaaaagagtgtaaagcccagcttaatcactttcctgttttaaccacttcttcccaccccaccccacttcctggttaaatttgtgcaatggtaatattgagtctttcctatctcatacggaactgataaaaatttttgagataattgtccagaatctcctgtacttattttactccttgatgacgtcaagaacatttattaactcctttagactattacgatttcatttgtgtctcactgaatgtttgctaataagtttaaattcttgaatcaaaagaaatacagaattggtcatagtgttacgggatccttggggtttcgctttgccagctggaaatctctgtggccagtgatgcctttgcctgagttttgctcaggcccactgggcctgctcagcctggcagactacgcttggctcatgctactggcctggatcccatgcctgccaagggcgagtggagtggcgaggggtgtgtgaatgagcaagtatggggtccggccactgcacacagtggtggagctggcagctccagacaccgccacaggcactggctgtctgtgaggctgtggctggactaggcatcccgcaagtagcttccatggctggcaccaggggacacagtcatgcccagaagcttggaaatgccaggacctgcagagccccaaagagggtgtcactgccctggcttggggcactcctaggtctgggctccccaaggagccacagctcttctctccttgttgcctgcaatatggcaaggaaggggtgtgtttcagccctgtttgtgttacagctctttcagccctgccattaggcaggttccaagttcttgtcccatgcccaggtagaaggaggtatgcagacaagtgggagatgagaaaggtgaagaggagctttattgagtgatagagctcagaggagactcgcagtgctcctctccgcagctggtcgtccctacgtctgctcagctctcagcagagaggagacaccagagtaggtagcttgtctccacaggcaggtcgtcccatcaagtgctcaaggctggctgaatctggagtttttatgggcttcagagggaggaagtgcatgctgattggttcatgggtggccataggtgggcctagaaaaagcaccataagttcccactccagtttgcaggactgacagcctggcccccaggcttcaggccttccccagcttgaaggtggggcctcaacaggggccttccccctctactccagagccagtctgcctcatgccactgttcatgatgcccaggccattcatatggaggggtgcctgcaggccagtgctgagctgccctcagcccccctcagcctccctcccatgttcattggcattctaagtctggagggggtcaaggcagcagagggctagtatgtcagtgcttccctgagtgtgtgcatgcctggctgggttgcaacagtgcccaggcttggcctcaactttgctgtgagattggagcaggcactgggagtgtggagaggccaggcagtgggagcgggcctgcaggggcagtggggggcttcctgggcccttgagagtgcagagatgcccaggtctgcagctgcagcttgggtggctgcagtggcacctgcctgctgccagccccccaccagctctatggagttcaaagcccagccatacctccccttctgcagccagcatctccgcagtagccactccagatgggccatcgctaccatcaatagtgggtatggtcaatccaaatattactgaggacactttcttgtttgtttttagaggcagggtctggctctgttacccaggctgcagtgcagtgatgcaaacatggctcactgcagcctcaacctcttgggctcaagcaatcctcctgcttagcatcctgagtagctgggatggcaggtgtgtgctaccatgcctggctaatttcttttttattttttgtagagatggggtctctaggttgcccaggctagtctcaaactcctggtctcaagtgatcttcccaccttggtctcccaagccactgggattacaggcatgagccaccacgcccaatctaacaaaagacttttgaaagcattttttatgattatagtaggagagccaacaaaataatcaaaatggtaatgcatagaaagaattcccttccctgtaagctttcactaggtaaagaataggaagaacagatggattatataggtccagcttctaaaacagttaagctgttatattgtaaggtattgttgtatttgtgagtaacttgagattaggagccaaatattttatccttacgtctcagtgcttgccaatgcacgtagtgggtgatcagcaatattggattaaataattgagaatccagattctctcttataattctttcacagactggcatacaaaagggagcctgagatttaacatgcagtgtttggaacggggacttgtttttatcctgaggtcagaaacctccacagctgagtactttggataatgaaagtccattttctatatttgcccagcttgggctggacacaggcaaatgtcatacaatctgcgtttaaacattcttttctttccattttaagcatttgtgtttcctgcagcacatctaaaagattcacaatatttactgtatatttctatgcttttaagaaaaaaaaacatgcagctttcacatgcaagttattttcagcaggcagttcctttcctgaaacacaaaaggctagatataaaaacaaacaagagggagaatacactgttttaacaaatgggtcctcagagatggattttaaagcatggattttgtttcccgatctagcttttaccctatcacttcacaacactgagagaaatcctgaaataaatcagtaacgtttgcacaatttttaaggctgacagttttatttttttcctgttttgtctattgctgtagccaatttaattaggtcatacccatgtgaaaagtttgttgtacaagaaaaattttggatgtgtgtgagtattttcaggaagatttgtttctgctaatgttcatgatgtcctttgcacatgaaactaattcacttattatcatacacaatttagaatattattattgtttccaaaaaaaaaaacaactctaattcaaggggaaatacatgtttgtttacttttagatcatggttagagcaattacactttatttttagcagataaaccactgattttaaaacatatttttttaacaatacagattagatgccaacccaagaagggatcatttgagtagaaaggggagaaaggactaaattataatagtattccagaagtggcagcagaaatcaaacactagcctacatacctagagcattgccctctaatttcacttttataaaagttgtttgtaattcttaggtcctgggtattttctaatagactttttatgattataccaacagaggtaagtttcaggcccacaagaaagttattgcttctacactcccagaaatgttaagaaccacgggagaatgccatttttcgcaaaatgaagatacttattcatgttttctgaaaaatcttgatgttaactccttttcctctttaatgagctgaatgccttgcttttatttttatgtatttaataattttagtaactatttaattgagattcttacttgcttccgaaacatcaggataaatagatacaagaggcacaatttaacatattttattggctgaacataaaggtcacaattaccaagctttatagacacaccattagaagtatacagtagatcctttgtagagaccatgaatgagagccagtgtaggcgatgtcaggaacagcaatacaaattttgagttgctgtctgtgacgaaagcccagcaattgtcaagagtttgactgggtcgcaaaagaatttaaagggccagcagctctttaagaatgcatgcgttagctttatccttatgtaacatttactgtgaggcaaggcatgccaaatattaagcaatctactgaattctgctgagtccctacccagtgattctattttcaaatgagataagtaggtgagatatacaaatgaaatcagaggcttgattaatgctgcccatccagaaatctacaatgtgaatggatcactattagtaccccagtttcagcattttcctaagaaaaaatggaaataagtgaaatagatgggaaaatatggtacttttttggaagttaagaagtttgctttctaaaacaaaatgtacatagctaatcagatatacttctgcaattctgttttcatgtattaataaagctagatttcagcatcacttaagtttttaccaagaaaagaatttgaagctgggcatggtggcttgcacctgtaatcccagccctatgggaggccaaggtgggcatatctcttgagctcagggattcaagaccagcctgggcaacatggcaaaaccccatctgtacaaaaaataaaaataaaaaactagccaaacatggtgaaacacgcctgtggtaccagctactgagcaggctaaggtgggagtatcgcttgagcctgggaggcaggttgcaccactgctgtgattgcaccactgcactccaactgaactccagtctgggtgacacagcaagaccttgtcttaaaaaaaaaaaaaaaaaaaaaaagatttgttagtgagatgtcagttttcctaaattacattgactaaattttttgtgacattcaaaatttgccatggtctcttgctagattcctaacatgttctgtaaattctcagcttttagtagaatttgaagaatgcttgtggaaaatcaacaatgctttcaaccattggtatggtttggttctatgtccccacccaaatctcgccttggattgtaataatccccatgtgtcaagggcaggaccagatggaagcagttggatcatgggggcagtttatcccatgctgttctcatgataatgagtgcatctcattagatctgatggtttcataagcatctagcatttctcctgcttgcacgcattctctctcctgcctccctgtgaagaggtgccttctgccataattgtaagttttctgaggcctccccagctgtgtggaactgagtcaattaaacctcttttctttataaattacccagtctcgggtatttctttatagcagtgtgagaacagactaatacagtaaatgggtacctcagagagtggggtgctgctataaagctatccaaaaatgtggaagcgccgttggaactaggtaacaggcagaggttggaacagtttggagggctcagaagaagacaggaaaatgtggaaaagtgtggaacttcctagagatttgttgaatagctttaaccaaaatgctgatagtgatgtggacaatgaaatccaggcagaagtggtctcagatagagacaaggaacttgttgggaactggagtaaaggtgacccttgctatgctttaacaaaaagactggtgtcattttaccccctccctagaaatctgtggaacttttgaacttgagagagataatttaggttatctggcggaagaaatttctaagcagcaaagcattcaagaggtgacaaagcataaacgtttggaaaatttgcagcctgacgatgcagtagaaaagaaaaacccattttctggggagaaatttgagctggctgcagaaatttgcataagtaatgaggagccaaatgttaatcgccaagacaatggggaaaatatctccaggccatgctagagaccttcaccgcagcccctcccatcacaggcccggaggcctatgagagaaagatggtatcctagacctggtccagggccccgctgctgtgtgccatgtgtgcagtcatgactctaaggggctaaggtacagctcaggccattgcaccagagggtgcaagcccccacccagccttggcagcttccacatggtgctggtcctgtgggtacacagaagacaagaattgagtttggggacctctgcctatatttcagagggtatatggaaatgcctggacacccgggcagaagttttctgcaggggtggagccctcataaagaacctctggtagggcaatgcagaagggaaattggggttggagcccccacacagagtccccactggggcactgcctcagtgagaagaggcccaccatcttctagaccccagaatggtttatccacaaacagcatgcactgtgtgcctggaaaagccacagacactcaaagccagcttgtgaaagcagctgggagggggtctgtaatgtgcaaagccacaggggtggagctgtccaaggccgcgggaacccacctcttgcatcagcgtgaacctggatgtaagatatagagtcaaagatcattttttgactttaaggattaatgactgccctattggattttggacttgcatggagtctgttgcccctctgttttgaccaattactcacatttggaatgggtgtatttacccaatgtctgtatccccatcatatctaggaagcaactaacttgcttttgattttacaggctcagaggtggaagggacttgccttgtcccagatgagactttggagttggacttttgggttaatgctggaatgagttaagactttgggagactgttggaaggacatgattgtgttttgaaatgtgaggacatgagatttgggagtgcccaggggcggaatgatatggtttggctctgtgttctccacaactcaccttgaattataataatccccatgtgtcaagggcaggaccaggtggaaataattggatcatggaggcagttttctctgtgctgttctcatgataattagtgagtctcatgagatctgatggttttataagcgtctggcatttcccctccttgcactcattgtttctcctgccaccctgtgaagaggtgccttccaccatgatgttaagtttcttgaggcctccccagccatgtggaactgtgagtcaattaaacctcttttctttataaattacccagtcttggctgggcacggtggctcacacctgtaatcccagcactttgtgaggctgaggtgggtggctcacttgaggtcaggagttcgagaccagcctggccaacatgatgaaacccccgtctctactaaaaatataaaaattagccaggtgtggtggcacacgcccatagtcccagctactcgggagactgaggcaggagaatcacttgagtctgagaggcagaagtgcagtgagccaagatcatgccactgcactccagcctcggtgacagaataaaactccagctcaaaaaaaaaaaaaaaaaagagaaagaaaaaaagaaagaaagaaaaacaaattacccagtcttgggtatttcttcatagcagcatgagaatggaccaatacaaccatgtttattcttcagctacggtagcaggactgactttgacatgctgatgttctttttctttttcttttcttttcttttttttttttttttgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgtctgcccttgccctttcattctctgtctctctgtctctgtctctctctctctctctgtctgtctctctctctgtgtctgtctgtctcattgacaggctctccacctcataaagagtacaagatgaatcacactaggtgacttttaaatcaagatgaatcacaccaggtgacaacttctgacctatggtacttggtttccttactatagcgtcacacccattatctaattctttttcttcctcaccctgtgagctagactgaccagcagtttgtgttgggaaatcagatggagtataatttgacatttctttcttcagaatctttctaatttgacatgtcagtgactgggtctgccaaggaaatggttcttaagatgctatttttcctaaaaatactttcatagctctcttcctccacccattccaactcactacttcaatcccagcaaacagagaaaagaaattaagccaaacctcttttcaatttacataccagaaaatattttagaaaacaagctcagaagagtgcttctgcagcactattggaaaatctagccaggatttcctctgtacaaatctacctcccattgctctctgcattctgtccacatcatttttatttcctgtgtgtgaatcccattgccaccagcttgtcagtaatgctgcccctagcagtggggccactgctcacattttaaaacatccctgaattcctttggccaggaggagatagtaacaaaggcctctaaaaatttctgcagtgtccaagatgtgcttggttaccatttttttataagctcatattgccctctttatattaaggagccaaggaaaacagtatttgtgtttacttcctgaaaaatggcaggaaatcaaggtacatctgtctgaaaaggaaacagtttatattaatagatggatggagagattggtagatagataaatcaatagactgataacttacctgtccagagataacttttgtccttcatagcaatatggaaaggtattttatttatgttaggttaaaattaaggtaaatattcacaattcaagtactatatatatttttagtttgaatgagaaatttttatatacagaattattaactagtaacagaaacagagtagaaaggtggttgtcaggtgctgggggtgaaagaaatgaaggattttgatcaaagggtacaaaatttgagttataaaatgaataagttcaagtacagtctttaaaaatcaacctatatctttagtatccttaattttttggaaatctagtacgatttctctatccccaaagttcttaaaatagacttatttcatcacagcaggcccaatggaaacagggacttttttaggatcaagaattcagaaatgaatcttaaaattttttttgaatggttgctcagtccagcatttgtttacatctgaactgttcaatacaataaccattagctgcatgtggctatttaaatttaaactaaagttaggcaacattaaagagtcagtttatcattcaccctcaccacattttaagtgctcaacagccacatgtgtttggtagctgccatattggagaacacagatataacacatttgtatcagtgcagaaagttttattggacactgctggtctagatgttcaacttcctagtgaaattttttaaggttcatcttttcctctcaagttcatttctaaagttctcagatcgccattttcagaaacgaagtgtctttgctgtttctcagaacaccctgtgttgataggcagtagctgtaacctgtctctcagaacaccctatgttggtaggcagtagctgtaacagtccaattcttggtccagagccaccacttgggtgctcacttgggtgttgtgcaacaggagagcctgaagtatgctctgcattcctcagaggcatagaattggccttgattcagctgtcagtgaagtgccgtcagagacattctaaaaaaccatgcagagaagggaaagtacaggaaggaaggattaaggggttgtttaccagtaacctagagggatgtaaatacatttaatcattccaggatagagctatctttttaatcattcaatcaaaaacaaggaggaatgctatgaaagtatttttctcaatttagtatatccttatagatacctactatatttaaaatcctatgtggcattttagataaaggattaggaggattcttctccatttcttatattttttaacagaattttctttgcatacatcttaccaaaaaaaagtatttattgggttaaaaattagttttcgttccccacacatgacaacatagaaatctacaagtaattcaaatagagacatggtttagaatcacagattaaattgtctcagggagagacataattttctaaagaatgaagataaaattaaagttgttttattttgttttgttttgtttttgtttttgtttttttagtagagacaggatgtctctctgtcacccaggctggagcacagtggcatgatcatagcccactgcagcctcaaacttctgagctcaagtgagtctcccacctcagcctcctgagtagctgggaatacaggtgcacaccaccatacccagctaattttttacattgtaaaaattttcgtagagatgggggtcttacagtcttgtccaggtgggtctctaactcctgggctcaagcaatcctcccaccgaaatttaaggccaggcatggtggttcacacccataatcacggcactttgagaggctgaggcaggatctcttgagcccaggtgtttgagaccagcctgagcaatgtagtgagactccatctctagaaaaaataaatttataaataagtaaaggtctagtttcaaaacaatgccactgccgtttagcaaggtctttgtacggagaggcagagatcaattgtccatttgggtttcatagtgaatgtgtatgcattcatattatggtttctttttccccccatcccaatctaaaaaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtatgtatgaacccatgaacgacattagaagtaggcactcttgctatgttacaatttatattttctttccatgaagttgcaaagtactatcagtcacccttagcacatcctgattctcatgacccattcctaatcccaggaaaactctaggatattttgttcttggcaccaaatgtaagacaacctaaaaataatttataacttgttttcaaaaaagacatactctaactaaatgtaaatatccctgtcctggaatcttgctagaacaccaagatactattaagtttgctatagacagtcgatagggatctcactgagggagttttgcctctggcctgccaaagagaccttcttatgcagtgcctttgaagcagaaactttccaaggcaacataatgagcatggtatagttctataatttccaagtgctatcacatacaataattctttgaccctcctatttactcagtcccactcaactttgaccccagtggatagttcttacagaatgagaggaaaacagtccaagaggtcccaactcatcagcatatgatactagaaacatgctaaggcaataaaagaccatgaaaccgcctgattaagggtcacacgctcctgggtgaaacagttagtggatatcattctttccagtgtgtctaaatgatatctgcattcataatataaacatagtggatattttattggtcagaaattctattttgaacattaaaagaaaaccgtaaactaatttgagttttcaaatcaaatatgcagtttaaaaattttttcctcagaaaaatgttgaactgacacttataaaaattccagtgaattttaatttctagataaccacataagcaagaaaatgtgtccatgcccagttgaagttattgaaatatttattcagaagtgcattttactttcttatagttttattgtttggctatgaagtatattgctttgctaaaacatttttctttattattttgaagttaaaattttattatatcttgaaaaatactccaaaattcctaagaataacagcatattttcatgtatcatattttacaaccttcccaaggttacatagttaagcggcggcgcaaagcagatgcaggccgcctggccttgagaccgtgctctcagccgctgtggcacaaccgcctctcgagtgctttgttaagaatggcacatcctatctgtattagtccattctcacactgctatgaagaaatactggaaactgggtaatttataaaggaaagaggtttaattgactcacagtaccacatggctggggaagcttcaggaaatgtacaatcatggcggaaggcaaaggagaagcaggcaccttcttcacagggtggcaggacagagtgagggcaagcaggggaaatgccagacacttgtaaaaccatcagatctcgtgagactcactcactatcataagaatagcatagggtaaactgcccccatgatccagttgcctccacgtggtcctgcccaccacacgtggagaatgtggggctagaattacaattataattgaattatacaattacaattgactcttacaattcaagatgagattttgggtggggacacagccaaatcatatcactatggaaaggaataagaactcaaccctatactcagattagtgcttagaataacctttgctagatattgctgaatcctgagtgaggggatgaatttgaacaatgaagcttagagtttgctaggaaaaatagacattcacataaacatgacataagaaagaataaagtaatggagagagttaaaaaatgacagaggagatgaaaaagtaacaaaaaattctctattaattcttgaaggatgtataggttttgaacaagtaaagaatggaggaaagggcattagggactgagggaatagaattagcaggagcccagaggcttaatggtgtgtggcctgttttagaaccagtgctgcagtgtggcaggggcagagagtgagagaagccgggcagcagaaggcaggcctgacaggtagcttgccggcaccatcaataatctactagagttccccagctgggtttcagcaaacaccctcccttagctattcatagtcattccgcaatgggaggatccctgacccagtatatttgggcaattgcagagattcacaattcacattagcattttagcagctctaaaatgttctagaccaaggaaacccattttgcttaatttaacctggtctttccagaacactagcaatacaatcattgtgggggagcagaacactcactgatactttgcataatattaaaatgctattcggatgccatggtaaggagtgagatttttatagaacatagtgagccatgtaggttttggaggaaagaaatggcatgttcctatttgttttgaggcaaaataactcttatgaaagtatgaagaaataaatttagaagcaatatcagaaaggctgggaggttattacagtgttccaaaagaatgagattaaggcctcaaatctggagagtggaaataaaaatgggaaatgagcttcccaacaagaggaatgccgaggaaagactgagggacaatcttccaaagctcatgcttctcaccacaatggctgactaaaagaaaagtatatagagcatttgtttgtttatttgtttgcaggaggaaactgatgagttcagatgtaggcctggtggctcctaaatattcaggtttggatcttaggtgagggaccaggataaaaggtaatgatttgaaatgcatcagcacagagatgatatttgaagctatggagatgaaaaaaggttgatctgggagactggaaggagagagaagaaaggaaaagagatgaggaagtcaggggagaagaaggaagggaaacaggaatgttatagataataccaacatttaaagagtgaattagaagacagtctcaccaagaaactgtagcaagttcagaaagaaaaacaaagaggaaggagtttcaggaaggaagaaatgattagctgcacaaaactttccttaaagtcagggctgaaaagaggctatcagactacaagtaattctcagggcagattatgtcctcagtgctacagtgtcatcagttgttgaagttatgacaccggaaacataaagtgaattcttggaacataattaaattagatctatattacattacatcttatatttatgtaactatgaagtgcatttggttctagaatgtaaggaatgtcttccttacttatagatttgtagagttccctgaactcactaggaaataaatactttaaaagaccaaaataacaatctctaatacttggttccctatatttttagaaaaagtaatgtagtaatcatgtatcagccactggacactttccctcctagaatatggtcaaataaaggtcagtctacatgccattttgtctacagcagttataactgacccataaggccagattcagcccaacaaagtgctttgtttgatccatataacatcttaacattttttgagccaatatgaaaaatacagagctattttctaaaaatatagaatttctagaaaaatctagcaacagagtctttgaagtcgagcacagcgctgcttgcttggaactgagtaatagcagcccctttggacatgagctcttccactgtctagtgcctactaggcccatgtcactggtttatgcaaacctccttggccactaggacatttgagtttgcaaaccttggtccctctcaggtccaccttcactatggcccattccaagtcaagtactaaaacagtgggccttccatgtctctttcatttgaacccctaaacaacttgtcaaagctatgtagccttttgcatgtgtttaaaaagtttttcataatcagtttaaatggtatcaaataatgtaatttccactatatcatacattttggtgtttgaaaataaaacttttacattattgtttgaaactaacccaaaggctctttgctaactaccttagcaatgcaatacctagttattcattttttaaatatgtgaacaggcttttttttataattggaaatttgacatcactttcttttctccttgaacttatatttccattctactttctccacagaattttatcctactataatatattttatacttaaaattcattttactcatatttctttccaacagaacatgtttttaaattagaacttaatttttttctgtggccataagactctaaggtgttcaacatttcttttatactgttaccattacaattattcctagtgtacagttcaacaaatcaacatgagtaacaaaaacatctgttttgataaatgattgtcaaaaatgaaaaagactcatcagaataatagatatggaaattcaagatctgggaatgtattcccttaaagctgtccttcccatactatcttgtactccttgaaaaggcatcatgtaccacaagttaaaggaatcccagcctgaagacttctacttcaggtgctttacatcctgcagaggcactgacctggagcgatgtgcaacattagattatgaggaggggcagccagctcccacattgaccactgacgttagccaaatcgttaaccacctcttctcacctataataactgggctagcacactcctattttcccttctacttcaaaaatcctacattgcaaagatttccttattctcaaataacagtttctaccatgtatctgataattttctacttgagattatgtgacaatgagccaccaatttctgcccatgtcctaggctttctggcaggcctccaatctctccttacatctgcagccaaccttagagaacactggaaatttaaggcaaaaatgggcctttggcattcaacagccattctttttaacctcctcctttcttagctatagcatcattcataatgaagttttctataaacaggtagaagataaaagctttttctgtggtttttacatcttaatagaaaacccttaaaaaccaaaacctacaaggtggaaaaaagttcatttttacttgtgggacttcagggactgtggtagcatcagatgaaagatcaaatttgaaaatccttctcaaattgtaccacctgttaatcaggtttgttctatgtacttcccttcccctaagatcctgcactaaaatatgtgtcagagagtatgtaataatcaagacagaggttaataagtctcaaatgagcaagtaggtcacaagaataggaagcatggtccatccaatgcaaattccacatagaagcaggaagggtggccaggtgaacatgtagaaataagaatctggcctagtcctgggccagagtttatgttctgaaaaaccaggattcatctcagtatccctggaaatgtagcagtgctgagtatctcagttgatgctccatattggatggatacatggatgggtggatggatggatggatggatggatggatggatggatggatggatggatggatagatgcatgggattcaggaagagtgactaggcctttcaatagccactgatactatctcctgtgcccttttaatctcccttacaattcatcatctttcagttaggaataatgttcagatattcaagcacatactaaaatgcttgcattaattcagtaggtagaatgcctttactgagtgcaatagagagaatttaatgtcagaatgccattgctctaaggggcaaggaggagacctaacactctttagctaagacattctctttttaattatgttaagattaaccatgagaaagactatatctctaagacagaaagcttaagtagtcagtttccagattaaaaaaatcatcacttctttacaagcatttacaaatgcttgtcagcaggctccaaattcatgtttgacagctacaaatgaattctgatgtgggcaagacagtgtttttgaagccactgtgttagtgcatactttgttgcatacttcaaacttatattaaaggcaagtatattaaaattgtttgatctaaaatagaagccctggcccataaaacagtcatggacttctttttcaatctaattttaaccatattacatttttaaaaatttagaaaaagaaaacactattgacgttttaagtttttaagttaaaatattcgactttctatgagaaatccacatttcactctcaaaaaagatgacataatgtccttcaattatttgttcttgaagtacatcggcacttccacaggcaaatgagacactgagttctagactagtggtatcctgattattattagttttttttttttattttaaatagagctgtctaatgtatcatcagtgtccccaaccaggactttaggagaatgggaacagtcaccctgggacagcctccattttagggaagaggagaaagttcagagcaaactagaacaaagactcaggatgagggtaggatggaaaggaatgtctccatttacatgcttaacaaggtgtgccttgagtactggcatttctgtgttgatcccaagttgacaagattcctgaaaatgtcaagcttggaacatattgggcttagaaaggagtctttcttcagcgagggcttctcccagaatgactaacctgattccccaccatccccagccccctagcctcctggtgttatcccaggccaatgacatcaatgtcatggtaaacatttccatatgggaaacctagaaatgatttatttttcagttagaagaaaatagatgacaagtccttgaacacaaatgaaaacattcagaatcaaggcccaaaatactcaaacttctccaagaactcatcaataaatttctctttgcaagatatcccatcaaaccacaatgacttatttaacttcaagaacttatgcagcccagtgtagtaaacaaagttaggtaagaatcaaaatggaaaggtggaattttgaaagattttgaattttttcctcagaaaaagatggaaggggtatggtctttggatcattgtcacattgatgtgggccactcagctagcacctctcatcctcactcagtccgtgcatctgtaaaacaggactgatactcaccctatcctaaccaaagtatattaaaatgttaagaaaagatgaagctcatgatgaatgtaaattattacttttagttcctttataattgcctgttctattgaccaaaggaaagtgtccctgttatcacagtcgctggatttttcttaaacttttggtttgaaatttaagcatggaaacacctttcagaaaatcaggatacttactgcaaactacccgcctataccatttaatgaattgcaaagggatgggagacctggtttgtgctcccaggtctcggcatgttatacttgtgtgtaatatatgccttttctgagtctcagtgagggatgagtatctggatatttgtgcatttctttgaacttggaagaaattgcaaaggaggatgatgagatgggtcagtagatgtggtgactcaagacgagtctagaacttgcttacatatcttgagttgctaaacaagctcagcatgctttcaataaggcagagcttgtctttctagtgtgccttgtcccagttgtcatcacatgctttatgatgatattcctagtgggatttagagtaggcagacactgaaatcactgggagttggtactagttaagtcattcggcctcagtcttccctgaggctaatcatggggtcctctctgttcctccctagtgcttccatatttagctcttccttgctacaggccccagggccttagtcacctccttatagaatggccactgtctcgccagttcactgaggttcttccacataacacggttctcctgttcccagcagagaagcatgggccatttgtccttcgaaggcctggaagtagacacaaatgttaccttcgggggccaagcattatttatggtagtccataaatgattgaagagggctgggtgaaaacagagacaaactgaaggactgcctggtccatgggttttttgttgttgttttttgttttgttttgtaatgcggaaatgcaggcccaatgttgcctgatcttctggttgttgtttttgttagtttttttttttttttttcaagagaaaccagaaatctgatttttttgatgtgaaatgtattaattggtaaattttagcaacttagtaaatttttaaaaatacattgtcactggcaatattctggttcttgaagaaaggagtttatgagtgtttgttaagcattttgctttatggcttatgtatacattgtagataggagtattattaaatttatcatcaaaacctgggcagtgtgagagaataaaggggaggtgattaatgattttgtcagggatgagaacttttcacattttatgtcctccagctccctattttgaggagatggaaaaataagtatctgtaaaaaggtatagagatgggccctgatgggcaggcaggaagacattcaggctggaattaacatggtgcattcagggcatcaggagacctgatcagtttcagagaaagcgctccaaaaggcaatggttgggatacatctatttgataggctagagacagattaaagactgatatgaaagccaaagcagagggttcccaactcagtgtaactggcaataggaactaacactcgttcttgagaaggagagggcagtggaatacagaacagaccagaggaacagaacaggagatgagatggagcaggcaggttcacgacttaggatgcagagcacagtttaatactacattcagcacacatttgctgaacacctgcagtgtactgagcactgtcctatgagctaggagacagaaagataggaaggacataatccagtgggggggtcagaaattttaaaagagaatcatcatgtttcaagggatagcagagttgatattggtaggaagagtggaggcagccagatgaaggaggtgggaagtgagaagagcaccccaggcagaggtgccagcataagaacgtcgtgtgaaaaggcagtgacctgctgctccgtgtcctgagcttggaaaccctagtgagacattaggagagagtgcaggcaagaggatcctgcaggccttgagacagggcagaaaacaaggcctccagaaatgaggcagcaggaggaagtgtatgagaaagcagaatagatctagaaagagccagcagatcagaggataagatgggcaagtaccatgtcacagaagcaaagagaggaagtggagtttcaacagcggcctttaacagagagagtgcgaaggtcagagacccagaagaaggagggcttggctagaaggtcactagtaggctctggcttccatctccagataggctaagattaagccaattcaccattttcccacaactgtcaactctgcagaattgccttttcttcctctcagacagaaagggaaatcccagctgcctgagcaaccggtttttcactttcctccttgtttgcagagtctagtggggctggccctggtaacctctggtgattcatccagcacaccctatgaccacatccccattgtgtgtgtgtagagaggatgagagtttatgtgttcctctgaacgttattacaaaagaaaagaacattgttctctagaaatatgaaagaaaaagaaaagaacaaggtgttactctagcatagttttttctcaattatctgagttgtgaaaaaaaaagtaatgaatagtggagcttcctcaaaacagattctgagcgctgtcagtagttaacagtaactactgtggtggaattcctgtgtggatctattttggcactgtgttacgtaattatttttatcttaggatcagatctgaatcattcaaagccaatgtcttcagggcactggtgtgactccaggtgttctcacatgcctgtctttcttctcagatcactgcccaacactgaatctcaagtgatggacctcagtgcatatgaattcggggcctatatgttttgtaacagcaaatcctaccccactggtgaaaaagtctaataacctgactgattttctattttgatgagccctcaattgagagattatattgtggtagtaggttacacctgcccaccatgtgaaaaacaaacagtaaagattgagaacccaaatgtgtgtctttagaaattaatccgtacaatttaaaaaactgccaaaggaaatgtaaaagatagtttcataattgttaggtattaataatatctattctaaatgtatggcttattttttactaatataatagaaataaacaggcttggacctaatgtaaattgattcttaagaattcactgcactaatagtttggatttttgtgttcattctatttctgtggcaggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatcta

SEQ ID NO: 783 - DNA, 605418 bp, Homo sapiens; identical to SEQ ID NO: 782

SEQ ID NO: 784 - DNA, 429348 bp, Homo sapiens
ctcattttcatatcaattggcagaaattatctttattagaaaaatgaaattttcctgtatttacatttttacaccatatgaccgggcacttctgttgcctcaggagttatatacatatcagtttgcacacgaatttcaatccccattccttaaaacagttgataacacattgaacaaaattaaaagacatactacaagaagacaaccatagtatatacttcctctatcatagaaaggtgttaagcaaacatataattttgtagctatgcttggaaatatttaatacacttattagcacttcctcatgcagtggattaaaacatgacagatataaactgctgcagttgatcagtgaacattaattcccaaatgaagaccattgcttagagcagacagcttgctttcagctccaccatacaagacatcaagtcagttctgatgtgggttttggattctgtttgaatgtagctgtgaatagaaaccctctgcatatggagttcaatcctagccttgttgggttaaaaatggactcagacataaacctggatagctgcttaattcaataactttcttgcaggcaatgaccagcttgtgtattatgcaacaagtcatattattaatacgtgagtgaaaaatgaatcatttatcctctttgagaaggccattatttataatttttatgatctaattcttattcaagctaccaagaaactcaccttattctttctgaacattcagcttgaaatatatatactatacataaacatatacacataaacattctggggtgatataaactatggtgaattctgccaattaattcagcaggtttatgcttttaaatttgttttggcaggggaatgaacaagattaagattcatagttaaaaacaactggtaaagaaatctttggggaccctcaggtttggaaggcatctgagccacatctaactatgtcactgctgtgtcaagcagttttctgaattttctatgaaaatgttattcttgaacttatatcttaagtaggcaattagcatcccttcccagtgaaaaatttggggaacatgaatgttaaaagttccactttcatcttttcaaattcatcaaaaatttcaaacaagatcacctggatttggctcaaattagaggcctgaatcttttgtttttaaactgaaacatttacgtaagtggtcatggccccagagcttttctacaaacttaataaactaaagatttaaaaaaatttaaaaaagattttaaaagtcaatactgttcattcacttgaattagcttgactgagaacagaaataattaaataagtcttagatggctaatgtagaaacttcgattgaattcaaaaggctatgattgtttttcatggaaaaaaaaagacaatgttttcgtatttctggatcttcgctctttgctcagttatcaatagtctttgatttgagccctttaaaacttgaaacagcaaaatgtcagatcaatgggaagcatttaaaatgccaaagacaaactcatgtttgctggagaacaattaacctcattaatttgaaaggcagctgtggtattggctatgagttatgttaatatcctattgaaggttcatcttaaatctttcctaaaggtgtgaaagagaattaactggaagaggtcatgacccagggctaatgaagaatgttctaggattgcaaaaatgcaaactcattgtttcactgacatagtaagtaagagaattatgagtgataatctcagttttgtcttcttcgtttctgcagaccgctgacactttatctgaggaagttaatctgaggaatgacttcattttaagcaatttagttctggttccctggagagttgcatgctttgaaatacaacccccagagaagaaatgctattggtcaaatcgttctttggagtgctccatttctgcatagctcaacattccaaggagaacatggtcacgcacttgtagacccaacaacaggatctccaaataacaaataataatctttctgtcttaaaaggctttttactgccagcttgaaagatgaaaacagctgagaaatttttctcatagactagcacttaacttgcattaagttagctaactctccagagaattcatggagactcccagaaagacattccttcaaatccccgctagtgtcctcatccatcaaatgggcctaatgcacccctcacctctcagtaaatataaatgccaggaaagaaatgtggcttagaccatggagaggggggaatgcaggaaaggcagtgtgtgctcaggggcatgcctgcaggatatgttaaacattaggccattctgggtacctataaagcccggtggaagcgttccagttcaacactcttcagtgggacagaataaccgtcattatcctaatgctaagtgagccgggaattatctctaagacaatttggaaaagaaaaaaaaaaaggaacagaccaagaaggaaaacaacaacaacattttaatagctggtcctcaatcattctgactaccaaagctctccatcattcatgcagaaactctatttcctattccctgtcccacctctgaaactcattccatctgcctggcaaagataaccaaacatagacatgaaataggaggaatagtcaacttgcaaataatatcacctctttgaacatgggtcacaatatttaggaggactttaatggagggtcacatggctgtgtgtgtgtgtgtgcatacccacacacatgagagcatgtactatgtatatatgtttaatggaattagccctgatgttgactgataaaaagatgagacattaggaaagagatatttaagattaggcacatgctaagtagagaaaataactccccagaaatttttttaaatgctaagtgcaagcatatgaaagggagacacaaacagtgttcaagtctcagaaggaactatgaacagaggtgagatccccagaagttctccatacacacagatcaggcaatgaggggtaagaccctaacagacttccctgtcacagaggctgatactcaagggtatatgcccaggaacctcaaaagagcacacctctctttctgacttctattctgacctccctggaggagaccaggcactttgaaaatatgtctaacgttagggatttactagctaattctagttgctgacgaggttgagaaaaacctgagcctcagtttccttatctgtaaaatgggagcaatcatatttatatcttaaggttgttttgaggatcacattctaggatatgcctagaatatcgcctacactcaatttagatatattttgatattttcaaattcaggtgcagatccatggcaagtacttgcgataagcagaaaatgtaacattccaagaatgcacagaatgggatagacagagtgacaaaagctccctctccacctcgccatccttcctgaaatacacctctattccttttgccatctctttgccccgttttctctctagggaacctgatgctttctgtcagccacagcagtaggcacttggaacttgataaagaattttccctctatgcttccctgatacattcataccctggtgtatcagaagggttcttcaaatgtcaaaaacaaaaccaaacaaaaaagctttagggaaatgcttcgtctttttacatcatggtctattttctaatcctttggggaattttttcaaccttttcttgaggcacatgtcataatgcaaggctgggaggaggcatgatttggcaaggactggagaactggttggaaccagacaaaagccttcctgtgcaaaaatgtaggagtgtgagtgtgttcacctggttagcagctcctgggtctcctaagtccattatttgaagattaaaataaatcaactgcatttccgggaccactaactctattctccggagttacttaaaggtttagggaaggactttttttttttttttaaaaaaggtatgctcatagaatcagattattttttttttcctggctacaactttagttgtcatttctaatttttgctgtttagtctctgtttgcattgcatgggtccttggttatcctttgtattagagaactgaacttctaaaccataagctacttatgggaagagactatattttctatttattttgcatcccctcccccacaatcccaaactggctttcaaaataaagtggacattcagtgaagtcctattagctggtcaatgtgcttggttcttcctcaatgcatgatacatagacctcaattatttcaatggtcactgccagccttttatcttcagtttgaggttttaaacaatatccctgttgatttttcctaaggagacggtctctgagaaaagttttctcttctaggaactttaagacagggattgtgagggagtttaaaggaaaaccaaattcaaagaagcatgggtaggtctttctggggcaagtggcaaaaacaaaaaacaaaacaaaacaaaaaccagggcagccttatggggatctctggctcttattccagagctactcaggagtttccccttgaaagaaacctagaaataagtcagcccggtcagagaatcgagccagaaattgaaccatgtcttggatctaatcctcgctctgatactctctaacttgatgatcttaaacaggcaactgcccatttgtaaacttcatttttctcatctctcctccccttctcctaacttttggtgtggttctacgaactctatttttctaagacccttctgggcaggcacttctagctaatactatactgaaagtactgctgggcacagaaagagtgcaggtgaggaaagaggataaggaatttaaataggaaatctatgccctttgatgtgtttaaggaaatcacacacaagtccatatcggcattgtcttcagaagcaaatgcgagcagaatatattctatacccctcatcccagagttttgttttttaaagaaggggccaagaacgccaacacccatattctacttaggctctgtcatcctccctacaactgagattaaaaaaatatagtgccctctctacagaaatatcctcccataaaaataaccagaatgggttttccatgtgttaataccatcatcaccatttaatttttaacataaactttacaatatgtacaattttatttggataatacacttacgtgtgaattgtagaaatcaagcatgtatattatatacatgtgtacacaagcagttgtattcacaggataagtgcatttgatcatctctgatctatatcaagtggcaagctgacctcatctgatacaattagatatgaacacagtacaatgtatagggattgaatgggaaacagtaactgcatattgggagaacttttcaagtatagaccccacagcactttcaaccctgttcaccaaaaagagatggggtatctggaaaggtctaattttgtctccagtgaaaataaacagtacttttggaaggaaaattgcctttacatagaacccttcactcattaaatatcaagcaacacatttagcttccacctactcaaacttctttttctttgagtccaatcatgtctactatagccatggttaatacaaacaggctccatttcagaaacaacgcatgtccccttttcaaggattcatgcacaacagctatgcacaaagaaacagtacaggaatgtgcataatgttaacgaatatatccagctcctctgtaaggtatttagagttctcaaattagtgtttatttaggtcttaaaccgcaagggatttcagtacaaggtacttatttatatgacaactgattattaaagctgcactttttagatttaaaggagataaatttttaatcaccatttaattaacatcaacattttttttctttttcattagcaattctatttgcaaataattcagggcatttgtcatttcctgtgaaggatgcagaatattaaatacacatcagtggtcgacatagcaaatagaataaacaatgtgtgactatatgacagctgtggatcttttgactaattaactgccttggctagagtcccatttaagtgaaactatttcatttgtaaacaaggtgtaattttctatttttctccccagaaaataagcgtgaaatgatttgacagattttgctgcaatgtgtgaattttaatgctttcaccagaaaaactaaatactcagactctctggcatcctgtgaatcagggaagagaaaatcaagagtaatccgtggatgcccagtcatggtgctggctaaaataacgcagagagatttgcagaggacataacagtaatgagtggtgagattgtgagattataatcctgcaagtctctctggcagaaagatagacctatagggacttgccagctcagagcattgaaaccataagtggcctaagaacctgcagatgtaaggatgatgaaacccattttccagaagcacaaaggtttctcaagtacagtttatgctctagaagactctcttacccagagtattttaaattggttgcatgtgcgtgctattacccatggacagagacccaaccgtttgcattcaagtgtacctatctgaggactagttgggtccttctcaagtggggaaaaccaattagaattaacaaaatatcattatggatgccagctctgacttaagccagctgaaactcaggcatttgtgttcagaaatttgggctccttgacatcaacaaatctaagaactcagagctgggatatgttacgggaatcttctgtgatagatctatagtctcaggcttccaggcttcctatttaattcttgttacttctcatactgtgggttccatttaccactggacgttacattcctgatattctttttgcaaagactgaactgacttagatgacctttgaataactctacatcttttccttagaaattgaccatctgatcagtagttgattttttttttttttttttttttttgcttgggatcatcacattgaagagtcattgaattagtagagaagggataccataaactttgtgtagcataacatttctgattatttatttgaaaaaacacttcggtcagtgaaaagaatatatatttttttcacaacattactgttgattcttccaaaggccacgttttcagtttctttatccagagatgtatggggttaatagcagaaataatgctgctgttaggggaaggctttctgaccgatgaagtcagtccaagtataactctcactctccctggaggtctctgtggcatttggcagccccctgggtttagaggacaccagaggaagacagaaagcctctttggcttgacgacaaatcactcttctgtattctgggaagactttttaattcattcatgtcaaaacatcccagactcatgaggaaatggaggcgatccttgctggggtggattaaggtctggaatgcactggaagggcagaaggtagaaagggctaaaaggctacacagtcatggagattcagatttaggatcagatgttggggtgactattctgggcccttcgatccaggcttctccatggctgggtcttggggcagcagaggtacagcatccgggaaataaaatgtcattttcaagcacatgcatccccagcacctagtcagccccttctgcctttcaaaaatgaaaggaagctcctctcacccactgcctccctctgtctccctatgattgaccctgaaatttattgcaaccacttttcattataggaacactgtaggtcaggtgtactttcccaaagatggagctattccatgcatccttgagctttaagggaatcatccctgacacttgcccacatgcaagaaaataatacttacaaaacagaacgcacaccatgaggagaagaaatgggataatttttcaacctgccactttatccctttcttcaagaatgtaaagcagaatgcaggaggaaaccaggaaatggccaggcgagtctacattagcttagtgtttccgtaatggcccaaaacagactgaggtcttctgcaaacactgatggctagttatcccaaatacttcaaaaatattcatgtacatgaaatacactaattaacagagtagaactatataaaaggtttagttaatattatttgctggttttatgatatttaatttttaaactagaaaatcctgatctgagaaagtgtcataacatagcaactatcttgtcgggggcacttgtttttgtggcaggcactgtgctaacaggctccccatgcataagtattcccctctctgtctctaacttaaaaaaaaaatggatatcatttcatgtcatatatgcacaggtttgaggagaataagaatgggataatgcaggcgactcagaaatgacaaatactttgaggaatttttcctacatctctgttggtgctatgaagtggtttgccaccaacagagagaataactcagaagggagaaattgcttgtctcactaaactgtatccacagtttggaggatactcagggtagatccaagagtgcctcgtgttttgaaggcttttgatttgaggagtttggggtggaagtgagtgtccaacagaatttctggatgtgaaggaagataaacctaaaaccatgctagccttcggcagacagatggcattgtacttcttacagatcacagtacacatacggctgttggtgcatgtcaccacattaacaactctgggaagagcgatacacagctaattggacaccaccatggctgtttggaaacggaacgagttatggttactctgggagggaaggggtaacagatactatacaaccctgagtcatcaccagaagggaggaaatgcaaacttacgtacataggcgtcttcgggataaactacaatggccactgtgtcacagacagaagatccacacttagatctcggagacataaatgtgttagtttatgcagctctgaacaagaccatcgaagccgagggtgagagaaacacacatcaacatccaaagagattcctgtagctctccccacctgagggtccctcgggcctttggctccagatgtgtcttggaaatgaactataatgaaggtagcacagtcatcacgaacacactgatttgctattctttaggggagcctggagttcttggggtgagcctgggctgtgatggaaggcataacaagaaagctgaaactgttacgagccaaacttcctaatctcttgcacatgtcaatcgcactacagtgcagatgcattcttaactgtttttattttgtctgtgtcaggtttacatgcacaccatattgcttattctgtattagagaaaccattaggcatttctgatgagaaaattacatggtgggctgaccttaatggaatttggaatataggaaatcataacatcaccattggcatccaatgcatcattattgccaacatacccagtaggcatgtcccggagacttgcccttatgtagttagttatttttggttaaggactcacctatctggtgtctgccatgctcagcacacacctcacaagattccttgagtggaagattatggcatgaagccgtgtgcaaaagagccaacaacaacaacaacaaaatacctccctacatcttcttcctcttagcagggcactattggacatccaacatttaccctccagaacattggccattacgtatatttccctatagataaaacattaatggaagatttttaaacatcagattcgatactaggcattttcttgtacacgcgtctattgctgcaggaatttaaaaccctgggggtagagtacatattattcttatttgcagcataaggcataacatgctccgaaatatacacatcattgtggccccgactgtccctggaacagtacgatgccgttgacctcaaggacgaccgaagatagctgtcattcaccgcctgggatggcaacgagtgtttgtaagggtccgaggggcatctcccaataaccaagcgttggtcatccctgtgggagtggaggaaagggttatcggaggtgtggtctggcaagagagacttgctcctcttgctgtcctccagaccttgggggaaaagggagctttttttccccgagagtttgcttgaggggacactaaacaggctgccgtaaaaatttccctccagaagccgttccctgtccttgaggcttatgctccgggagggcctgctaaggtctagctccctaggtttgtcgacaatgttatcgtaggaatgctgacggctaatccttagcttgttcttttgtaattgaagggcattgttctgtgcccagtcctgctggtagacctgctccccggtggctgggttacctgtctcctgaagcatctggtcttcatcgatgtcatagaggttccccatccgcaggcaggcatcgcacttgaagggggacctcatggtgaagtggcctgaataggtgggcatgttggaaaggcagcttctgcagtgcgtggagttctgccggtatcgctcgctggtctcactgtgcggggaacccttgtctttcaaggtgaagtgcttggagtagagtttatactggtcgttgttggaaagcccctcttcattatgcaaggggttccggttcattggcagcgtggagtcccccttgcggaagttttcactgggatcctggtaggggtccgggaagtccacgttctcgggcagggtcacattttcaacaaactggggtggatctaagtggaaaccaggctccttctcaccatctatagtgtagatcttgtctctaggggagcttgatttggttttcaggtaggtgcgctcgacctcactacagtccttggggtatttggaggccactgaccttttaaagttgtccttggttttgtggttcttactgttgtcaggttccctgtggcacgtggcccgatttgacgtttctgaaatgtcagagtgggccatctcttctggaagatacctagggctctttagggagtgggtcctattctctgctgttgcctcatccctctgggagactggattctgggatagtgaatcctggcgtatggaatccacggatttcttccacagctgccggggtctagagttcgctttggattctgtgctcacggccacctccaccgtgttagggttggactcattgagagtaagaggatgttgtccctggaatacatagttattgaggttatccttctgccggttggccacaaatgtttggagttcgttcatgttgtctccaaaaatgctctctttcccctgaaaggacctgttgtctgagtacatcaaattccccttatctgaaaccatgtccatgatgagggaacctctttggatgaagtcagcagctcttttgggtgagtccattcttgaggagttcatgttggacatgctggaaatgtttttggctgaccggaggagttttaacatgttgctctgggatcccgtcagattgaagtctggagacttcttcttttcttcaatgtgcactccatgaatgcagctgtagatgccctgtaggggagcaacataaagcactgtcagcagcagcagcagtgaacatgaaaccactttgcacttgaactttacctgcaaaggtgagatttgcacttcttgcaggagccctggagaaacagcaaaattcagtctgaatcctgataatgtctcttaaaggtatgagacaagttgcaaagcatagggtttatcttattgctctggctcaagattagctgacacctttgcaaagagtcacacatggagtttgagaaaaggtatcaaccgatgctcatacaactgtcaatgcctcagtgtctccaaagtggcatataagaacagataactgagcctcccagcacccgggtcaccaatccaagctttcattaaagtttcccagcatcatctttgaaagtttaggcaccagagagttaactactgacaaacacagtcagcatgaaaggatcatccattgttaattcttttctggaattacccctactcttatgcaaaagctaacaatcaaagaatgtgtcctaagtggccaatcagaaaatctcttctccatgcacacattgattcatctaaaggaaggcatgaaattcatgtgaggctcatcatactctttgagggggggatagatgtggatgcttggatagaaggagttgcagacttaccatcatgtgggggtgtgagcctatcagtgaagccattgcagtgaaaagtagagcccaagagatagagaaagacatggtttaaacccctggagccactcccttgaacttttttacttaatcgactcaatctattccttgtgtgtttgtttgtgtgtgagtctattcaatgtagttagaactgggttttagttactagtcacagtgaagagttctgatgacacagtgacaccgcctttaaatccatccagggaactgaatgacttaagggctcctgggcagcccaaatacaagcacctccatctatatgtcttctcattttctactctttctttcttttagaaaacaactgtttacgttcacttaaaagtagctgttcaactgttatcaagggaagagcccttgattcctaccacaataacaggcaaaaggacgtctggaacattttgatctgtggcttcccctgcttctccccactcctaccccagatttcagcagccgtacctacaggaaacagtcagatcaaggctgcaggatttgacctggtcttcccaaggctgacagggagccaaactatgaaggggtttgtagggcagaattggcagtggctgctgactttggcataaactacaggaaagtaagtgtgattaactgtggactctgataatggtggctccatcggtcccccatggtggggacaagctcaccctgcagggatgctcacggaactgtgacagcctcaactcattttcactgctacatttttcttgtagtagacagtctctccactccagccttcaaggaaccgtaaacacaaaagcctacagttgcaagtttgagctgctctttctctgatcctctccaccccaggcttcatggttggtgaaggccccctgaggctcagggcactggcattacatcctttcctgcattcctgcaaacttatctgtggtctccttctatatataatgtgtggttggctgtttgtcctgccacaaaataacatctgcccctgccatcactgcttccagagctgctggagcatccagactgtggatgtggaaatcttacaaatgagccactgcgctccagcctgggcaacagagggagactccatctcaaaaaaataaataagtaaataaatcaaatcaaatcaatcaatcaatcaataaaagcacattgctcccataaaacttggggtccttctcccctagggatggagaggccaaagttcaaattctagatgatcaagggactccaccaacaatgcctgccctgtgctgcccagtttgccttccattcccatcctttggaaaggaagatatggatttacttcatttcttaaaatgttgataaatcaacttggcttccttagcagtgttttagatagatagaggaaatgctcttccaaaaacaagcaagatttagaagtaaacgcaacagtgtgcatttgtttggtgctaatcccagaatcatttggatatgaaaagcctttggtaattggctgggagaattagcttaaagttggcataatacctagctctatgcacgtacgttgttatttttaagcaatctatgtgtttagatgccatcaagctaattaggaaatatgtatttgcacagaacccgagtttggagtgcaagtgaatggagaaaataaatcttcctcactaaactaatgtgtaccttccgaatctccacagttcttgaaactagcaaatgttaagaatatacaaatctgttttaaagcaattagttagctttctcagtaaacaatagcatataaaattagatttttatttatttatttttattattatactttaagttctagggtacatgtgcacaacgtgcaggtttgttacatatgtatacatgtgctgtgttggtttgctgcaattagatgtttttaaccaaagagttttcaccatttttcaaatcctaattaatgaagttcttccaaggcaaaaaaacaaacaaaaacaaaaaaaaacacaaacaaaacaaaaaaacaaacaaaaaaacaaggtgggcaaataagagagatgagtggataaatagatggatgcatagatggctgaaacgaatgaatggacatatagataagaaggtagatacatatgtattttgtgctgttgtttatgttgagttgaaggtaaactttgttttctgcttgatacgtgtgcattttcttctgttactttacacctgtgtttcctttcatgtgctattgcattccacatgctctttgtgttttattagatgtgtatacatattccatagcattgcaagtagattttgttttgttgggcatgttctgttacaatgcatacacaaattgtaacatcttgcatagcagcattagtagtgttatacagcatacctgggtgctagtgatgggagccacaggctggctctgtctggcccagtgtttttaaatttttttttattttttgtttttatttttttgtgagacggagtctcgctctttcacccaggctggagctggagttcagtggcgctatcttggctcactgcaagctccgcttcccgggttcacgccattctcctgcctcagcctccggggtagctgggactacaggcgcccggctaattttttgtgtttttagtagagaaggggggggtctcaccgtgttagccaggatggtctcgatctcctgacctcgtgatccgcccgcctgggcctcccaaagtgctgggattataggcatgagccaccgtgcccggccaaaaaatttttacatggaattagttactaatatttaaaaatggaaaggtttctaacaaaatcagatgacattttctctttttaaaaaactagaagacctgataatattgactctacattcccataagacaatactcagcaggagttgaggatggctgccacgctactggtgaggtaaacatcatgcaattggccacagtcctcagtattccctatcgttctctcactttgatactgaggtttagctgccgtttcacgtcatctgtgctatttttctcatgtcccgcctgctgcacccactcccgtttcctttctgccttccttagtcatctaagtttgcaacacctggcttatgaatgcacaaaatctggatgctcttgtgacatgcccaagaaaggctggtaaggggaggaagtgcagaccccactgagacatcaagaacccaagcgcttttctaaacctgcttgcagtgcaagaaagtagccacccggtgtactgaccctgctgatggagaagagcaacccaggccggtcggagcacacgcccgtgaaacagaagcgcagcttccagtagaagaggtgctcccagatgaaggtgatgaggctaagggccatggcggcagccagcatgtagaatacgcccgccatgttgtcaatgtccagctggctgctcatcacctcgttcttctcgttgtggcagatcccagtgagccacagggtctccagctcctccatctcacctggacagatcacaacattcacaggcagtgaggaccagaacatgcactttggggcagacgcttctgggtttggaacagacgatgtgcaactcacagctatgtaaccttaagacaagtttctgagtttgctgggtttccatttgctcacttcttgagtgaagataataatgattacatagcctacctaatattgttgcagtgaggacaaaatttatatataaaaatagagaatataatatatatatagagagagagtatagcaaacttattctctattaatatgtatatatattatatattatatacatatataatatatataacttagcacagttcctggttttgttttttggagttttgtcttttttttttttttttttttggtcattattatgtttttctgaccttgctttcccttacccctgcccccaatacccacccaagcttggaacaagacatgggaataaaagggcagaacgtgacaatagaaagacttcattgcaattctgacttgatcatctgctagctgcatggcctcggagctacagttatcctgtctgtgaaataggcataataatagaacatacttcctagagtcgccatgaggattgaatgagatgagaatgtataaaatccctaaaggacccagatcatagtaagttttcataagcagtatgtttgctactatttactgttgtgaagaaaatgcctaacacagtgcctggcctgtggcaatcctcaaatatgtgtgtttctttttctctctctctttagaacattcaggattacttagaaaagtcacacatgagcagcatacttagggcacaaaactttaattgaaaagagacatccagctggctctgaatggccccttgcaaactaaactatacccaccccccaacttcagtaggcaattaaagaaccaggtggttttttccaatggggggaagaaaagagtaggcatgcttagaattattctgtccctcttttatgtgcattttatcctgttgccatttaggagaaaattctctgatctatatgtctagcaattatactgtctagcaattcactaaactatggcacttagactatgattcagcctttaaaaatgatctttcaaggacagtaaaaatcaagatgtgtatgctaaatgaaaagtatgactatattttatatgtatatacatgatctctaagatgtaatggggacatgcagagaaaaattaacgaaatactccaaatgtttatatcaattctctttgaagaagtcaatcaaaatgatttaatattggtctttttttaagttatgtgaaattagcatgtattgtttttggtttgttctcactcttgaatgatatggctgaatataaaaatcaaagttgacaattatttttccttgaccttttggagatgttaaattttcctctgatctggatggcagttgttgaaaagttggctaatcatctaattgtcgttactttctatgcaatctatattttctctctagttgcttttgagaatttcactttgtctttggtgtgaagtctagatgtgggtttgttttattggttcggctctggacttagtacgattcttcaatctgaatacttagaactttagttctggcaaaaattcacctgctatggctttgaatattacttctccctatcatatcttttttaaaaagttaatagattttatttttttagagtggttttatagttacagaaaaactgaacagaaagtacagagagttcccatatactacctctccccgctcccttcggttttccctgttaacatcttgcattagtgtggtacagtttttacagttcatttgggtaaatacctaggagcattattgctagattatacagtaagtctgtgtttcagctttgtaggaaactgccaaactttcttccaaagtggctgtactattttgcactcccatcaacaatgaatgagagagctcctgttgctccaagtcctcaccacccttttcattgtcagtgttagtgttagtgtttggggttttagccactctcatagggatgtagtgctagctcattatttcaatttgcaattccctaatggtatataatagtcccatctttttttttttttttcctgaaaactttaaaatactgtggaacttttcattctctcctctaggttatttaccttgttttaatatttgcattcttttttctctctgtgctgcatttgggtaatttccaatagatgtattttcccgttaatttattcttttgttggtaatatttagctttatgttttaattttatttattttaattgtgatattcatttggttcttttacagttctgcctgttctttttatcataatatcccatccttttgttatatagtttgttatataaagtttaaaagtttttaaaactttcatatatttaataattttaaacctctagtctttcagattactcccccccacccccaccttagttcttgggattctcattcctctgtttgctgtgtgttctgactctcatggtgggttacttccttgtgacgtctgtaacttttgaccatgagctaatcttctgcagaattattttccctctaagccccatgggactcccaagaacactaggctacagaaacatccctatagagagtttctgggtttgcttctgccatggttccaggaattttcaatgtatgagtttttgtatggaaaaatttttactttgattactacaccatttaagtagcatacatttgaactcacatgctcatttgggctttaatttcttactgacagcttcaaacagatggtaaacctccttgcattttcttcactttgatggacagagattttcctagttttctttttacagactaagtgactcattaaagttctcaaatgtattaaccagaaaaaaaagcatacatgttaatgagtttttttttaaaaaaataggaaatccatccctttccagttcctcacccacaaaaatgggtgctgatcaatcggttgtgtaggtaaagggatgagaagagggtatcttgattcaattccttttcttccaacagcctcccatgctttcgcacagtcacaaagtcatgggagactttgaaataatatctcactgtccaccaacactatctcaaactcatccagatttctctgcccaccatgtacctcagacctgcacggctgcttcctcttctcacaaaaacaccaatgccatccctttggaaatacaatgtgctgttgacgtcccccctccctttggaggtattttgttttgttttgttgagatggggtctcactacagtcgcccaggctggagtgcagtggtgcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccctttggagtctgggaggacacaaaaatgggtcttctcactatgactcatcagattcccagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatacctctttttagaggaaatcaacatggtaaagcagacttcaatttcaaaaaaaaaaaaaaaaaaaaagagcaaatgcacatttctcattaccaattacagcctgttccaatcattttcaaattaatcatttcctgcctcgtggccctctttgactagcgtactgaactgtagttcaaatactttcttatttcatttttaatttactcaagtatattgtaatctcctggagggagatcagggaccatgttttatggttttgatatttttcgtggcctgcagcacgtagtgagcattgaatccatattttctgtttctgtttcttttcttacatccccaggcttaaactgggcagcattgcagaagtgttcaaatctgtttagtgagttattctgccatataaatagaaggaatacaaagcaaaggggaacttgcagcgggcttgagagtaaaaggctgggaaatgtgcatcctttaggtagggtgaagcatcaaatgtcgtttttccaaggagtggctctatgatatttattctgctgccagtttctcctattaaaaagaggccgtgatctttgtcagtgtgatcttgtgaaccagagctgataaatggggcaattaaatctctttcctgaagcagactcattcttgctgggaacacacaagctaaatgctctcttgggaacagatggagcctgggaagttttggggttgcagtcaaaccacactgcctttgtctccccaccggagaggactggtccccatgtagcactcaaagccctctccttttgtgtttccacctcctccagtgacagtaagctcatgcacatttgcagaacttctttgcgcccatgggaacttgcacctgttcttcctatatctgttttcaggggagatgtttccagccacaagtatctctactaaccacttagttctgcaccatcgtgaggaaagctgtaagttcagtagaaggagcaaggtgtcaaggtcactcttttcctaatgctgacaacattaaaagacagagtaatagagtttcaggagtcaaccgtcagagagatgcagaatctaaaagggaacaggcaagggtaattgaggcagtgttgtgtgtgtgtgtctccaacttgcttccattccatttaaaagggaacaggcaaggataattgaggcagtgttgtgtgtgtgtgtctccaacttgcttccattccattccactggctgcttgggtcaggctgtaagaaggctggttagacaaaaggcacagacaggatgcagacagtggaggagtttctcccattacccatccacccactgacaaggtggaagccaggggttttatatttgcaaaaaggaatgaaagaaaattcaactagatactgtccagcaaattacaagaaagaatgtttcaggtagaaaacactagaatgagatataaaaggaagcacccttcccttaagattttggggagcacatccagtcatctggtaaggtctagatagtaacacagaggtattaatacactcaggtattaatacactcaatatctgagtcagacggcctgcattagactcttggcttccacaggtaccggctctttgatcatggtccaggtactctactttaatctatccaactactcatccattcatgtatttatttttctatttaacaaaattacataaaatagactgtccttcaggtactatactagagtttaaaaaaattaactcatgtaaacttaatatggcttgtctagtttacagatgagggcacgcaggtgcagagaggttaaggagtttgcttaatcactctaagcttcagttttaatatcgagcaaatgggagtacatcagaatttatctcataggagttttgttagaattaaacgatgttgcatacacacagtgcctggcatacactaattacaaaatcagtatttctggagatattattattgcctgaaatcagggaagctggggggtgggatggaccacataatgctctctgtgcccttctaactcactctatctatgattccaagaacgcaagtccagggagaaggttcagctctccatggagactctcttatatccaaagtaagagaaattagttctctatttgccctaagactcattctcagcacttccagaggaactgcagtttttgggaatggattttatagcaagcaatgtgactagccttcaaacttcccaagtacctctcccctgaggtcatttgtgaaaaatccattttgaacctgtaccctttaggctttgtccaaaatttgctgaaacatatcttctaaaatcagcttccacaggcacacgtctacatattttttttttcttggtttcttgccaaagcacctgacccaaggcagtgatgaaagatgaaaagagagagtatgtggttctgagaagctgagttcgatgttctatttcatgtctggtcaaggaagctgttgctttttggttttccgaggacttcatttgttttttttctttactcattcattcactcattgaaaagagaaaatttgtaaagcacttaacatgtggcaaacatctctgtattttcatatagagatgaattacagatagtctttggcctctaagagctcattcctgtgagagagacagtcatgaaaaccagtagttacggcaaaatgagatgattggatttgcatagggctggaggcaggaagaaacaaggagtgttgagatcagagagcagttcaggatttctgggaaggaagaagggatcaaaggaggagcccgaagagtagaagccagaatgctaagaacttgattttcattctaacaagtctggggtacccagggaacagcaaggccgtcagatgtacatctgtagtgaacacccaactattttcttagtggacccaaggttcttcagttgttgctcatgtttctccagtcatggccccctgattggaaatccagtgtctcctcacatacaataggaggtaagctgtgatgagtgagtgtgcaatgtctcattcaaattgcaaatgtgtacaatggtgctaccatgtggaggaaggtcaccagtcaactctatcctggtgacacagtcactattagagtcctgtcctgatttcagagtcagacagaagacgcagcttaagctttcctgttccgaggttatgcagtgactgggagaaacgcacttacaagaaactgctggcaaggattcattgtaaactgtcaccaatatcataacccattacagtctactctggatataccagctgcatggtatttgtgctgaaaacttggcaatagctatctttggtgtatagctcagaggtatccaccttcaggaagtcttccctgaaggcacaggaatgtaaatatgacgccatggtttcctctaccataacatcctggattttttttttttttttttgtatagaatttgtcacagtggaacgtaattgtcactgggaggtgagtttattcagggcagggatcttgttttattctccttgtacccccagtctgtggcacaggtcttggtacatgtggttcatgacattgcaccaactgtggataacacaaggctcctgtctccttgattagtttgtgatccacagatctgaggatcggtcagagcccaagacaggaagaagtttgagaagccccaggcaaaggggtgaggaatagattctgaaacccagaaatcaaggctggctcttgggcgagtatgttctcatcaaagatcccagcaatagagcctggtggtttcctacagggaacagacttccatctatagctgaaagacgtcagaaggttgttgctgctgatctcattcgggttcgctgtgaacaccgagagggtaactgaccccatttcaatcctgtttcatgtcttgcccaggggttgggtactttgggtttctcagaagcccgattggaattggaaatggcaaaggaacaacttttttatgggaaatctagggcacagattcattggcaggctcatgttctcgatgacaacagacttggtcattctgagttctgagttgtggtcctgcaattgaggatggcctgggggacacagaattggggccaaatcctctccttgcccagttgtcctgtagatgaaaggaagttgtgtatcagatttggggatgtggtctgtggccttggagcagagtaagatcagctagaccatctgagctttgaccttgagggcccaacttcattaattccaccatcttgactcaaagccatgtgaggcaagtccaccctcccagatgcagcagtgagaaactcattcctttctctcttccctgtggtgacccaacacccatgttgttttaaagacaaatttaaaaactctcaaaaggacaaaacaaaggcccaataaatctgacaaataagaaaaaaaaatgagctagagaaaaataagacccaagtaaccctgggttcagaaataatattctggagcctgtgacctctgttctcacgatctcagagggtcactgaactatttgccgaagtgaaaaaatacttttgatggtggtggtgataggaaatagtacaagattctggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccgccaccttccaactgagatttctgctccatggatgaaacttgagtattgttaagttcattgctacttgtcacattgcaggatttcacaggccacgtgattagtcgcacaagttggatggagttgggggattttatgcacacaggttcccaaccataaaatctcccaactctggccgggtgcagtggctcacgcctgtaatcccagcactctgggaggccgaggcacgcagatcacctggggtcaggagtttgagaccggcctggccaacatggtgaaaccctatctctactaaaaatacaaaaaattagctgggcgtggtcgtgggcgcctgtaatcccagctactcaggaggctgaggcagtagaatcacttgaacctgggaggtggaggttgcagggagctgagatcgcgccattgcactccagcctgggcaacaagagtgaaactgtctcaaaaacaacaacaacaaaaaacccaactacaacttgtgcagcttcccaaccagtgtctctttcagaagaaaaattaaaaagaggattggacaataaaagattggacaactctatcaaacatcaaacaatacacatggtcataattttccattactggatgaagttggagagatacaattctttgaagtaagacggcagaaaccttgtaggaatccaggaaaccttattatataccaagcacttctggaatctgcttaaccaatctgcctcacacaaataaagacggtcaagctgacatggcttaaaaggcacatgcatttgtgagcacaaatgaattcatagtgactttttgccattgcatattttctcaatcaatagtcctcaaaatctgatgacttatcatgggaaggttatgaggactttttaatatcacaaaggagttcttgtgttttaaacacatacagatttaagaaaaaaaaggatagcaataacttcagatcccgtgctgttttgagagccactggctaaactgggtttccagtactacagcagctaacaaccctgccctaatgaccaacgaggggaagtaaatctgggtgtttacacgtgcctttcacaggatgcttcttttacctagtagacaacctcatgcctagttttcctatccatgaccaggggatctctcccaggaggaacttatttataactgctgatgcccttgcagctcttgtctgacccatgtccagtttatgtctgcctgatcatcgctctggcactggaagcccaaccttgtagtctccccgagggaaaacccagtctgcggtagttcctaggtcttcagatgaaaggtgcaaattcaatacaccaccatatagaaaataagctcaaagatttattacttacacatcctgggcagggagggtgcaatgaatcaagaggacagttttctgctcctgcatcacacaaggcaagaatgaagagtcagcccgagaaagagagaatgtggccaactagtggtacataaaagggaatagcgtgcgggtcactttaagtttgcaggcaaatgcctgaatgatccatttaaaggaagcagtgggaaagcatggagcctggtctcccaggttggggagatgcctctgagttcttatctctggccaggggcttcagccatttgggtgtgatgcttctcttgtaactccaaggtaacctatgctgtgttgctcagttctacatgccaagaaatagctcctcttttcagcaagtaaaattatctcactgcttttcagtttcttttttatcgaagtgttgtcaacaagttccttgaagctgtaaaatccagaagcgaaatggatcacttccatttgatctgtattccccattgcttagtatacacaaggagcttaatgggcatcggagacttagttgtggaatgaagagagaaggagagagtggaaaggaaagaaaagaggacagggaagagaaggaggaggaagaaaaaggggaatggagaaggacagaaagtgagaaataaaactattacagaagggaccctatatcagctgtcagaaccatccgtaactaaagcagaaggaagaccctgtttttctttccatagagggtaatagggtggtgtgcagggctgggttatgacttaggagagctctcagctcttcctttgatgacatcctcccgctccccaggtatggaggtgctcctctgacctcctctcccttttcccaagtctaaggcaccagatggggtgagacagtggccagggatgagtggaagagcacatgcgggtggcagagaagctagatatcaattctaactcaggaaagtaagtggggcagactccacagtcctctgcccccattgtactgacattaaatctgaggtcaggttacatgaaccaaggtcacaaaataaggcaatgttgatgttggggcaagaatctggatctctaaatgactggtggcaacagccaaccacacagccactgatgaagacacctagagttctgttgcacaagccagctttacctcttacagaaagtcgaaaaggagcacttgcaaattggagaaactacctgcactgctggcaggaatgtaaattggtttacattttcagaacactggttcaaagtatctactaaagttgagtagacgcgctctattacccagcaatttcattcctaggtatatttccaaaccaataagtgcctttgtgcacaagaaaggtacaaaaatatccaaagcagacaaaaactaaaagtgatgtaaatgcccatcagcagcaaaatggataaatttgtacgataaaataccacccagcaacgaaaaaaaataatgagctgtggttacatgcagtaatatgtatcaatgtcacaagagacatcaatgaatacatgttgtatgattccaccatttatttgaggatcaaaagaagacaaaaccaccccatggtcatggaggacagaatgttgattacttgtggggggcatattgactggcatgggccatgaggaagctttctaggatagtggtcacattttatagctcaatctgggtgggagttgcacagctgtacaaaaattaactggatattgggatttgtgcaatataacgaatgtatgtcatagtttatagaaggtaacaaatagaaaaaaacagtgagtggcatagtacaggtataagtgttcttttactttgggggttaagtgaggtaataataaggaaagttgaagaaaacagactttctaaaccagaggagagaaaaatacaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatctttttttttttttatggtaaacggccaattagtaaatattttcagcactacaggccatacggtctctatcacaactactcaactctgcctttgtagcacaaaaacagccatagacaatgcgtaatacaggaatgagtgtggttgtgttccagtaaaactttataaaaaacatgtaatgggccataatttgcagaattctgatttaaccaatcaaaacatgaaacatgaaataactttttatatttatataaaagagatagcatgttgcaccttctaaaatagcaaaaagaactgtaatgcctaatgctgctagatagtggtaaaattggtacattgatccactattactattactttagatggaaacaaaacttttttttctttgagacagggtcttgttctgtcacccatgctggagtgcagtggaaggaacactgctctctgcagcctcaacctcccaggctcaagtgatcctcccacctcagcttccaaagtagctaggaccacaggtgcatgccactatgcctagataatgtctttattttttgtagagatggggtctcaccatgttgcccaggctagtcttgaactcctgggctcaagcaatccccccaccttggcctcctaaagtgctgggattacaggtatgagtcactgcacccagggttaacaaaccttttgggcatcaatatgacgccatatatcaagactcctagagatctttagaaccagtaacctttaaattctacatctaagagtttgttgcaaatagttcaaaagaaaaaagaaataggcatgaagaaatttcttccatcgttatctatactagccaaatatcaaaatgtgtagcatttggaaaataatgtaatggtttctggtttaataaagatgatgacattttatgcaaaaaattaaaataattgtgaaagcagatagtatagttacataagaatgcttaaaatgtaataataagtgaaaaatcatggactataaaagtatatataaccaataattataattaaagaaatgtgtctgcaagtaacagggatcaggagataatacataaattaaaaacaattatgttaaagtagtagattggggtgattatatgtacagtcagccctttctgtatttgtgaattcaaatgatcacagattgaaaatattttggggagaaaatggtgtctgcactaaacatatacagacttttttttcttgtcattgtttcctaaaccatacggtgtaacaactatttagatcgcatttatattgcattaggtattataagtaaactagagatgatttaaagtataagatgtgcatagattatattcaaatgctacaccattttatatcaggaacttgagcatccacagattttggtgtctgtaggagaccctcaaaccaatcctccacaatactgagggacaactgtatatataatatattgcctttccaaattaaagtgtttaaaaaatatagactgagagggatttggggccactgtttatccatgccataaattttgcacgagcctatgtgacatcaatgtttgacttaccaacaagccattcattatatcttatttccactttgatggttctcttgacatttgactttctctggtttgagcaattcactgcttgtcaggcatgggcctggcatgctgaccttgtactaatcctggtgttggattgataacagacactaagattctgaatctcaacaggcccattagggaattcactgcaaatttacgcagattaaatcccctggagttttaccactgaggaagactcagtggctctccaggatatttatggatattatctgtttcttaataagtactgttccattattattccaaatatgtctctagttaaaattaggagggaaataaacaagtctaatttttatggtatcatctggtcacaggccaatggagaagcagttaagtcctttattgctaatctatgcttagaactgacatatctcttatttgaaaacgttgcatttctgaataaatggtttgccctagacagtttttgggtcataggagagtaagtgacttagttgttggggcatcagaatggttattaatgatcacccccttctgatgtctatatcatcagtgtattatctttgtgtatacatgaggtttatgtacatgcaaaagtcacccacatacgtgggagcaataatgaaatccacataaaaaattagactcaatcaacggtctttagctgcactttccccgtggtttcacatgagaccccgtctacacgtataaggaatcaggatagccattgcgtccaaatctagttccagatccgatttaatcgatagaagtgctggctcagtctttacccaaatgtggggttttcagttttgcctgctttatttttaacactgttattatagtcaataaatgaaaatgaaatctttggaagcaataaaggctttcatgtctatttcgatccttcctggatgaggaagcttaacattaaagcttatctgactacgtcttccattcatagcctaccctcatatctcctatgttctttattgtggttggcatgtggactaacgcttagaagtgccaaaccatttatgcctctagttttcacaatcaccaagggctctgtgtaaacccaattagaagccctgagagaaagagaatgaataaaactcagggcaaagattcaatatcatggaccccaactgagtgattggatggcaactgatatgtgtactcaacgtctgccaatcacaggataaaatgtttctaaatggtaaatattgttactttaaagagtgattcttaaaccttatggatggagctgaagaccattattctcagtaaactaacaaaggaacagaaaaccaaataccccatgttctcactttcaagggagagctaaaggatgagaacacatagacatatagaagggagcaacacacactggggcctaatggagggtggaggataggaggagggagaggatcaggaaaaacaaataatgggtactgggcttaatacctgggtgatgaaataatctgtacaacaaacccccatgacacaagtttacctatatagcaaacccgtacatgtacccatgaacttccaacaaaagttttttaaaaagaattatatggctgggtgtggtggctcacagctctaatcccagcactttgggaagccgaggtgggtggatcacctgaggtcaggagttcaagaccagcctggccaacatggcaaaacccagtctctactacaaatacaaaaattagccaggcgtggtggtgggtgcctgtaatcccagctactcgggaggctaaggcaggaaaattgcttgaacccaggaagcagaggttacagtaagccgagatctcaccactgcattccagcctgggctacaagagcaaaactctaacaacaacaacaaccaaaaaaaaaaaacaaacaaacaaaaaacctaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcaatctactcatctgacaaagggctaatatccagaatctacaatgaactcaaacaaatttacaagaaaaaaacaaacaaccccatcaaaaagtgggtgaagcatatgaacagacacttctcaaaagaagacatttatgcagtcaaaagatacatgaaaaaatgctcatcatcactggccatcagagaaatgcaaatcaaaaccacaatgagataccatctcacaccagttagaatggcaatcattaaaaagtcaggaaacaacaggtgctgcagaggatgtggagaaataggaacacttacactgttggtgggactgtaaactagttcaaccattgtggaagtcagtgtggcgattcctcagggatctagaactagaaataccatttgagccagccatcccattactgggtatatacccaaaggattataaatcatgctgccataaagacacatgcacacgtgtgtttattgcagcactattcacaatagcaaagacttggaaccaacctaaatgtccaacaatgatagactggattaagaaaatgtggcacatatacaacatggaatactatgcagccataaaaaatgatgaattcatatcctttgtagggacatggatgaagctggaaaccatcattctcagcaaactatcgcaaggacaaaaaaccaaacaccacatgttcttactcataggtgggaattgaacaatgagatcacatggacacaggaaggggaacatcacactctggggactgttgtggggtggggggaggggggagggatagcattaggagatatacctaatgttaaatgacgagttaatgggtacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagataaaaagtataagtttcaataaaaaaaacccttaatgtgtattagaatcacccagaaaggatgtagaaatgccccacaggaggtgaaaattaggtgtctgtattttcttgccaagtgattctattggatgcaaaatgtcaaaagcatctccataggcaagggcaatagagcaggagtgtttaatcatttttatatcccaccacctggagtttaaaagctgctcagttgttctttgttgaatcgatgactagaagggagaatgaatgaatgaacaaatgggtgaatacatgggaagggggttgtcaatggcacccagttcttcctaacttgattagaaagttagtaatttacagactagcccagctcatccccaactgtgatttctgcctttgaagtctcaatttgattaaaacacgtttagcaaggaacaataactttctgaaattctggagattatgcagctccaagaagctctgtggggaacaagcaattccagcaaccaagacaggtctttgtgaacctggagaggctgctttgcaagcctgtatcgaggccaaacatctgacttctcttaattacattctgtccttgtttcattccttctcatctcctgcttctgggtccttagttttccccaaactggcagggttgaatgatctcaaaaattaggctgggcctgctcccacggtgctggggcctgaggcatggacgagtctccttcaccatgaacaatggaaaaaaagtgtaggtcattttctctcccaccctaaacttctgtcgcaaagtgattttgcccagtaccttctgcagggtaatgatgctgtttcattagtaaaagaggaaggagcactgactctggggtgtgacctacctgtgtttaaatcacagccttgcccctttccagatgagaaaaccacctgtcttccaagatgtctatgagggtttatagcagctaaagaagtaacatcatgtaaagattaaagcaaagatcctggcgccctcctgcataggtaccaattgtaccaatctcagatctcccacttagctggataatcctggacaccttacttaactgacctgtgactcagtttcctcatatgtaaataggaatgaataattataactccatgccatttagtcattgtgaggggcaaatgaaattaatataaggaccaaactccgaccattttcttctcttgcccaaagccctatctaagggacctgaagagtcacatcctacagacaataaagtcttgtcagaggggttttattccatgctatataacatggcttagtttccaactttggcagaacatcacatgacagataaaggaggaagtcaaaatattttacctccaaatatgtttctttgccgtatttttaaatggcctgcaaagccattcttgttggggaaaaatgcatcttatatatatattctctattaacataacaagatctttccccattccaggccctcccaatcttgaagagactatctgagaatccagcatcttttagaggtctgaatagaaacactgaggcttcatgcacataagaaccctagtctccacaactccttctcttaacccagaaagtcctttctcttgattccaggcatttctataataatttaactctttcaaccaattgcaaatcagaaaatctttggactttgactctaccttttacttgtgccccaccctctaccccacttcgggttatcccgccctatcagactgcaccaatgcatgcctcacaggtattgattgatgtcttttgtctccctaaaacatgtaaaaccaggctgtagcccaaccaccttgggcacatgttcttgttctcaggacctcctggggggctgtgtcctgggtcatggccctcacatttggctcagaatagatttcttcgaatattttacagagtttggctctcttcatggataaatacatacaaggactgagatgattttgtgacatgtagttatccttctcgtgttacttattatgacaaatatctataacaatcatggtagctgttgaactacttccatgtggagaaatggaaaactgtcccatcctctcaaacgaggttttcagatgctctgcagttcctctcccctctatttttactttgcatttatctctttaattgggctgaggctgctggttgtaatgggtgttgctgagtcatctgaggacacagggacctatgtcaggaagaattgctggcagggaagccatcgaaagacagattagacatctccaaggcaggagtgagtcatctggtggtctgtgccttgtaccaacacaccggagccgaggagaagcacggatggctctgagacatcttcaatttcatctgcagcatggctaattctcagtttaataaaactagcctgctctgtggatgcacaggctaaacattgcctgaactatcacttagcaaacatttcttacctctcccactccttctttctttgcctctctctccctttactcctcccttttttctctctcttcctttctcttctctctccttactttttgactctattttttttctttttttttgggatggagtcttgctctgttgcccaggctggagtgcagtggtgtggatctcagctcactgccacctccacctcctgggttcaagtgattctcctgcctcagcctccagagtagctgggattataggtacctaccaccatgcctggctgatttgtgtatttttagtagaaatggggttttgccatgttggccaggctggtctcaaactcctaacctcgagtgattcacctaccttggcctcctaaagtgccgggattacaggcatgagccatcatgcctggccttcttttctcttctttatcctttattattaccacctccttctccttttttccccctctaatttctccctcatatatctctatccctttttccttccccacactatttgtctttctttcttcttgttctcatcttcatcttctcccttctcttaggagaactggacaaccaactttaagtcttcttttttttttttttttttctgagacagagtctcattttgttgcccaggctagagtgcagtggcgcgaactcgactcactgcaaactccgcctcctgggttcaagtaattctcctgcctcagcctcctgagtagctgggactacaggcacccaccaccacacctggctaatttttgtattttttagtagagaaggggtttcaccatattggccaggctggtctcgaactcctgacctcgtgatccaccctcctcggcctctcaaagtgctgggattacaggtgtgagccactgcacccagccttctctgcccttcttatctgtctccagacagtctagactaggtgccatcaaacttgttctgtaaaaggccagataataaacatactggcctttgcaggccttatggtttctgttgcaatgactaggctttacatgtgattgggtttcaataaaacttcattttcaaaaccaggcagtaaccgggatttgggtcatgggttttgataaatgctaagggaaatactattttttcttggtcgccctcttcatcataaaccagcagactaaagaacagatttcagcctcatggtactaatttctgggcccctgaaggtacagtccctctctcccaggttcttgattaaagagactgaatcccatattccagaaccctccctagatctggtggacatggaagaaccatgagttctgacttatgttgctgactattatgtgggaacgcctgaattcctgtctgagtttagagaatttggaaaacaaaccttggttgataagatatatgaaacatacatacacacacacacacacacacacacacacacacacacaaacacataaataaattaaggaggacgcttttgagtgtttaaattcttaggactgcagcagcaagtttagcaaagaacacagtaggagctcgatccagtttggcaaagggtctggctaagtcaaaactgtgcaattatcattcctggttgttggggttttagaattctctattcatgctaatgacattgcaatgaacaaaaccacatcagtgaagaacagcaaaagtcaagggtggagcaacgcagctttatttcacaagcccctccttggggaaggcattagagctacagtttggaagaggtttgcatggaagaaagggagaaactgtgaacagggctggtttgtcaaagaaagacataaaccagtggtgtgtgcctgggaacactatggatatgaaacttgtctactgttctcccattagcatgcagtcttgcctgaaataaacaaagcacatgttttggagtccacattgtttctcctgtcttgcctctactgtgctgcagggaaggagggtgcctgggagacagcaaggctcattctactggaggcttttatgatttggatggggctgctgaccaatatgcctggagataccccaactgtcctctacgaccattacttctactgcagaggtcaagtctttcccaaagaaacagaacaaaggaccatcactggttttgtgttccctttgttttgtttttaatatataatttgtctaggaggcagagaacctgggtttgagccccaactctgcactccctcgctgtgcatctttaggtgaggtcatatcccctctgtggcttcagtttccatattactggactaagtagcaatttatgatccactacagttgtaaaagccagggaatatataattctgttggttatatgcctcatattgcacatattaaatatgtgcatatatgtgcctcatatgcatattgcatatattgcattaaagagcataatacagggatatttgactattataatatacaaataagacaatggaggaatttgcctctatcttgtggtgaatacagaggtaagatgcctgggaagactgtcaaaagattggcagtgattcagtgattacctccttgcatctctctctctagaggtatctagtgtcctttctaaagaaaataaggtccctttcattaaagaaggtattaaatcgatgacataagacttgcaaaagtgtatctgcagtattttctaattcattcatttgttcattcattaaacaaattttgtttatgccaagctccactgagtcctgcagtaagggaacagcaacaggggtggacatggatagcgtatgccctcgaggaatctataatgcagtgcactcaagtggcccagggcacatggagaggccaacaatggcatctaatgtgtgccaggcatggactagcttctttatgtttattttcatatttaatccttaaagaattctgattttaaaatgagaaaaatgagactctaagaaattaatttgccccaggtcacaccactaggaaactgcagaaccttcatcttacttatttcacttctcttgctttgctaaatgccacaagtgtagagataagggagttcacaggcagggtatctagcttagaggtctttatgggagtattcacagaggagcgcagaggctgaaggatggatgagatgtcatatcaggaaatggggttaggaaaagagggaaggaggaattccatttttatagggtgttgcatgcagcaatccacacttatctaaaaaaaaaatttcaaatggtgaaattctggatgctgtagaaagttgaaagggaaaaatattcaggggtaaggggcattcaaggatttccccagtccacactgtcataccattcctaagccagccctaagaagactggctgtgaaggcctctcagggatacgccgtcctcagaatggacacatgtgtggtcatcactgcctgagctgtgggactgtccagctctaccccagactcggatgtcagcccaaagatattaagctgggaagttgatcaagggcagtgttgaggatattagcaacccatccagcggcccagagcaatttatgagaattctaattagatacaaggacttctgtgaccacacaaacactttctattctgcctgccagcacggggtcccctgccgtcaaaagctatcttgtatgcttcagtggaagatacaaggccaacaaaaaaaggactcaggatgccaacactgacccactcagagggagaaagtgagttctccattgacttccaaggctcccccactccaagatctgtgagcatcattatgctgaatggtgctattaaaactctagagtccattgcaggaagtttccttattaacatgagagcagggtttgtggtcctctccaatctgttaacaatctagatgagtctttaaaattattgctggcaaaagttgcagtacaaaaggaacagagggaacctgatgaagtaaaattgtgtgtgtgtgtgtgtgtgtgtgtgtgtatctttcaaatatttaacatatgattatatgtacaaatatgatataactggggtcactcactagttttaaaacttggacagtccaggcaacattggttgagttggtcactctattaatgtaattattttttggagacaaggtctcactctgccacccaggctgcagtgcagtgacatgatcatggctcactgcagcctcaaactcctgagctcaagcaatcctcctgcctcagcctcctgagtaggtgggcctacaagcatgtaccaccatgcccagtaatttaaaaaatttttttgtagagatgggtttttgctatgttgcctgggctgatcttgacctcctggattcaagcaaacctcccacctcaggctcctgagtagttaagattacaggcatgagccactgcacctagcctaatataatatcaatgcgagagatatgtgtaccatatctttcaaatacttcacatatctattatatatacctaaatatgatataggtgcaattgaatatgccatatacataatttttaacatacatgataaatatatacatttaattttatgtgttaaatgacctcagactagatgtcagggatgagtaatgtctattggagtttaaaaataaatccacaaccattaaaactgagcaaaatacaaagaagaagattaaacgcttctcaatactaaaaagtattacttatagctaagctgacctggccgcctgcaaaccaggtttctccttgcagcttggtttagtaggaaatgatcagaattggactcagatgaactagagccaattgttacctctataaaagtctgaacagggtgttgtccattggctggtagcctcagcatcacctggcagcttgttagaaatgctgggtctcaggctccaccctagacccactgaaacagtctttgttttaggaagatcctcacgtgattcttgctcatggtaaagctgaatgagctctgctgcagttcactttactcattggagcctcattttcctgctttgtgcaagggagataataagatttactccagaatattatataaaggcttactaggatattatatgtgatgtgcttggcatagtgctgaaccatagatgagaggacctaaaacaattttttccttcccttttctcagcatcacttgtgactgaataataaaattaggcattcttgttcttctcagtatcttttgttctggcccccagatatgagaagggtttgacctttatggtctttcttctgcttcttcaaaccccacaatcatttttttgaaaatcacaaaatgcatgagatagatgggacttatgggatcccctgttcacctttacttcaaagccagaaatgccattctttaagtccaaggcttacccagtcttcaggttctcactcaagtgttaccttttagggaccaagcagaatcgaggtactcaataaagagttgctggttgctggatgaataaatggctgagtcttctgtgaaccctggcccattctattctttgtctaaatcttgccacacgtgttttctttatgaatcattctgtcctttattcttaaagatactagttatgtctcgtatttctccttgaccattctcttatctacccaacacacctaagaatatatatgtatgtatatatatacacatacataagaatatataccacatacataacacatgtgtatatgtatgtctacatatgtgtatatatacacgtgtgatataaatttatatatgtgaattactagaaacgtttcgattttaggattagatattttgcatttatacatttgtcagcctactggactgtaagttcattgagggtaagaagaaaaagaccatgataaccccttctgggaatatcagtgcctacgaaaacatctgtttctcagtaaatgttgggtatcgatgctgagcaatgctgaaacatatgcatgagcattgttactccagtactgagagccaaagatgccatggtgcactctatcattttagaaagaccacagacaattagatggaaaaggaaggcaacatcttgctaggatcttgtgtatgcttccaggcagatgaacagcctttttcctagggaaatgcatggcaggcttcatgtaagaggttccctcaataaccaaacactccattcaaaggttatatttacacagctcattaggaaaattttttatacttttgacactcattagactcataatcgtccactgaagctactgtgtaacaagagataaacactccattctagaggatgaataattaggtactgctcagcactgtgctctttacacgtctaattttagagcataattaatcctgctgaagctgcatacgataagtgaaatatttatgcagctgtgttaattcatgtatttactcctagagagacattcagaattggtcatggctttccgggaagatcatctggagacaccccctggaccaatggcattttctctcccaagtcttatgcctcccgatggcctcaagagatgaagctgaatagagacatttcccaaacccaagtctgaccaggaaggcaatgagccagaacagaaaatatcgatgagaacctagatgttctgtaagtacatgaacaaacccctggcccatctggatgcttttactgtttattttttatttggtgcaaagaagaccttttctgtttagcaccacaaaagttgtttctgtgttactaacttgactacattattgccagtgcaacactaaagaagttgtgtttgatactagagttgtgcacgggcaactatggtgatgatgagaaggagaaggatgaagaggaggaggagggtggtggtgatggccatgatgatggtggtgatgatcgtggtaatgaggatgatggcaatggtcatgatgatgatgatgatgacggtgatggtggtggtgatgataatgataataatgatatcagaggcgtgtgaaccagaacactccatcttaaatagtagctgggtaaaatgaggctgagacctactgggctgcattcgtaaatggcttaaggcattctaagtcacaagatgagataggaggtgggcaaaagatatagatcataaagaccatgctgagagacaaaacaggttgcagtaaagaagctggccaaaacccaacaaaaccaagatggccatgagagggatctctggtcgtccccactgctacactcccaccagcgccatgacagtttacaaatgccatggcaacatcaggaagttaccctatatggtctaaaaaagggaggcatgaataatccaccccgtgtttagcatatcatcaagaaataacccagccttgggtctgctctgtctatggagtagccattcttttattccttaactttcttaataaacttgctttgactttactccatggacttgccctgaattctttcttgcatgagatccaagaaccctctcttgaggtctgcattgggaccccttttctgtaactacaatggtgatggctaacatttattgaaccacttgtatgttacagggtctatgctaagctaagctatgcactttacatgtattctcccatttcatcttcacaccagccttattaggtaattatttctgtaccctttcacagatgaataaaccgaggctaaaaaagatcacttctttcatagaagtatttgtaaatgggacagtagatttagttcagatgtgcactaaattactccttcctaaaggatttatacatctcaagagtttagtcatctttgatagataacttagagaattaaatataacaacagtcttccctaattggcccccttccagagtaaggtccctgaagtagaagctttgccacttactagctaggggatttgccctctgagattcaatttcctcctctgtaaagtgggaataagcaacatttaacctcataaggttacgaagattacattgaggaacgtatgtaatgcatccagtatgatgattgacatacccaagtccctaaatatgttagctgttttataatagatgcttcgagagtgacaccaatggtgggtggggctagagttagaactcacttatttgacagatacctatcacatttaaaagtttccagccaaatgaaatacatcttaacatcaatcaatcattcatccatacatgtatttattcattcaaacctttattgaccaatttacctgtgatgttcagtgttttgttgtaatgctggaaataagactcctgtttgctgaatagttcatcccctgtaagggtgattatccacccctgtgataggcaaaacatttggccccaattcttcagcatactctcagtgtccacactattgccataaaacttcaagacctatctcatgaaaggcagagtatacctgcaatcccttgaccctgaacttggccacctgacctgctttggacagaaggatgttagcagacgtgaacgtgaccaagcagtggcttgaaatgtgcatgtgcagctaggcgttcctttctgtgcttctgccatggccaggaaaagagcttccccaggtagctgctaccttttcagcccgagacacagcagaaacacgtgtggagcagagaccacaccactgattcgtacgcttgtggcaggaagcagaggcactatccccaccccaggcagagcttctccactcaacctgcactaccatgaggaaaataaatgcttactgttgtacgcctctaagatctcacagcaaaaagctgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacacgttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacacagctggcccaagcggctttacagttctataaatgccacagtctcattagactgcaatagagattgcctttccttcattcctccacgggataagaacatgagttgccatgttggtacaacatgactccaccgtgagtcatgcctgataagtctaggaaagagtctttgacctcaaaatgcatcagaaatcctttctctggagtgaaattgggactgattacagcctagttatgtaattttgtacagcagcgtttctcaaccacagcctaccaacatgtgaggttggataattttgtgttttgtgatgtagggggctgtcctggaccctgtaaggtgttttcctgcatcttctggccctggcctctacccattagatcagcaagcagattcccagccgtgatcactgaatgtgtctccaggcattgccaaatgtcacctgagggacaaaattgcccttcaccctttgagaaccactgccctagacagaagacctataaattcccacttaaggcaccaggactgtcctggctcttgtctttttctaaacctatttaactctttcctaaatcccctgagagagactgtatccttagaatacttttgtttgttaaatttagttatctagaattgctttccattataagcaacctaaagaaccatggtttcatgtgacaggaactcagtaaatatttttagggagcaaactcatcatgcaaagatccactgggaagcccaggagcaaacaaagcgagtgtgagggtctcaagtccccctaaagaaaggggtcacccggggtcttaccatcacccacaaactgaagcaaggccaggtcgatctgcctcttccaaggagagcctttctgaagggcaattccataaccggtggtggcaaagatgtacccactcccgatggtcaccagcttgcagccttcatccctcccagccttgtaattcaagactgcggcatcgtagatgaaagcgtccagcttcctgaaatgacaagaaaccagggggtcataggggtggccaggtaccacctcggggtccagctcctgaggcctgatcctgaaagcatcccacactttctttcatgctggtgatgatgactcatggcctctccatcccctcatcataaaaggatctatttttaatgaggagataaaagccagaaccttttctctccaacttacaagaggcagctaaataaagacatgaaggatccatatacccaagtgagtaaacagttgagtttgctggtttgctaagtgtttgtccttaacactcccagtggtggaggacagtgccctatttagaaaggtttgcatcagaacaaaataaaccactaaggggcagaagaatttggtggtagtgtgtatgaaggggaaaggaactaaataggaatattttttcctcccaaaagaaatacatgtgctgcttatttatcatacagaaattattgcagaatttttaaaaatccaaataatatagaaaagtattaaaaatacaattaaaattaaagctacctataattctataactcagattcaacctttgttaacatgttagtgaacagccttccaaatgttttagtgagtatgcacaaacacgcatacacagagattggcaaactttcttctataaagacaagataataaatagttgaggctttgtaggacataccgtctctgttgcagctattaaactctgctgttgtagggtgttatggggctgcactgtgtccacccctaacattcatacagaagtagggtgaacccctaatccactgtggctgccgtccttattaaaaggagaaatctgaacacagacatgcacacagggagaacgccatatgaagactggagttatgctgctgcaagccaaggaactaccagaagtcaggagagaggcctggaacagatccctccctggagccttcggtggaagcgtggtcctgcagatgccctgatcttggacatctagcctccagagctgcgagacagtcatttctgttctttaagctgctcaggttgcattcctttgttatggctgccctaggaaaccaagacatagtgccaaagcagccatagagaatgtgtaaacaaacgaactttgctgtgttccgataaaatgttatttaggaaaacagatgggtccacgggctgtagtttgccaacccttgttttaatcccgaaaatgttattatgccacacaaactatttcacatattgctttcttctctcattccatacctagtgaatatatttccatgtgaatacacatagcacttttaaattcttttttgatacacttatttttattgaggtataacgtatgtgtaataaaatgcttgatgaatttttacatatgtatatatccttgaaatcaccatgcagttcaaaatgtggaatgttatcatttccttagaaatcctatgcataccccagaaaataagcatcaggtaatctctccaagggcacaactgtgcctaaatattattattattattattattattattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatccctgtcagtagtcctggatattgtttccaaatgttaaagttatttaacgaggctgaaatgatcactgtggaatgcagggatgaatgtctcaactctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacagccgtgttcttcattttaatttttttttgtttctataatggtttgaggtggcgcaaaactgtaggacttgtctcatccacagaaacactctgaagctttgatctcaaggtaggggtatcagagacttggttttaggctctgagagtattaaagggaatcagatcaagcagcagcagaagagaactgggcactgattggcaacagcgatggtaacctagagctgtcatacgtaacctggagcaacctagagcttggcttgatgacagcaagtcaagaggaacagccagcaatagtgagacctgcagaaatatgggatggagagttatacaaggtcaaaagtaacttgtgtataatgggagtagggtgtgtaacaggaacactggagtagtaggtgaaaggaacctgagttctagtctaggctaggatgatggtgcaacctcaggaaagtcactttctccttttggatttctggtttctcctctgtgagaggtggcgttcattgtggtcttgctgagacacttgttcagctgtggtattctaagattgtgtgagccaacagtcacattctgtggctatccatagggaaattgaaactctggataacacatgtatcctaaggacttagggccgtggaaggtgttggtctcttgataaagctgagatacttgcaacgtcaatacttcccgtatccatgttgccatggagatatagaaacttggttttatttagactttctaagtaccacccaactctcgtctctccattcctcaaaaaataaacatatacacacacacatgtacacatgggcacattcaaacattagggccctctgttggaattcatggggtgaaaccttctcctatcctgctaagccactgtgcactgaggtgctgctaggctggaaatctacacacgtacctagcaaccacataagagttgtccagaagcagtttaagttggtattttatggacaggcatagacatcttcaaatcagtaccatatttcatgacaggtctttttgagctgagcaacagacagacatatgagtacaaggaataaaggaagttttctttgggaacaaagtttataaaagcacaatgctgaaaagtcagaggcaggacagctgcaaaagatgtggttgactctgaccaaagcagttacacattggcatgactggggtgggctggtggtcatgctgtcagaggggtctggccatggaggcacacaattgggccagccctccatggcctgactgtcatcttagggccatgtcagaactgaagtgattacaacacagaaaggaaactgtagggccacatgaactggtttctagattctagagagctggggcctacacacaatgggctacagacaactgcgtgtttaaaaatatcctggggcatacacagtcccctcccagagagatggtcattgtctgagataccatctcacaccagtcagaaagggctattattaaaaagtcaaaaaataacagatgctggcaaggttgtgaagaaaaagaaaagattatacactgatggtgggagtgtagattagtgcaaccattgtggaaagcagtgtggcgattcctcaaagacctatactgggtatacacccaaaggaatgtaaatcattctattataaacacacaggcacacatatgttcactgcagcactattcacaatagcaaagacatggcatcaacctcaatcaaacccaccagtgacagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttaaaaaaagagatggccattgtctgcaagatgttttataaaataatacttagcatttcacagacatcatcccactgaggcctcacaactgtccagtagcaagatattattattgttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatatgtttagtgcaaatgagttgtaaatttcatttaatttcattaatttagattgtaatgtagggggtcccacgtgcctatgggctattgcggcacagccctagctgttctgtggcaagcaaggggaaggcttagggagcaggactctgggtctccctttttgctctgacccaaaaagtctacttttgatccgttttctattggaaaaaataattgttcctgttgttaaaaagaaaaaaaaatcccctaaatctctgagatttgtcaacagggactttgggcaaagcaactgcatttctcaggctcagttttccctatgaaaaatggagccaacttgccgggcacagtggctagcgcctaaagtcccagcactttgggaggccgaggtgggcggatcacctgaggtcgggagtttgagaccagcttgaccaacatggagaaaccccgtctctactaaaattacaaaaaaaatagctgggcatggtggcacatgcctataattccagctactcgggaggctgaggcaggcgaatctattgaacccgggaggcagaagttgcagtgagccgagattgcaccactgcactgctgcactccagcctgggcaacaagagcaaaactccatctcaaaaaaaaaaacaagaaagaaaaatggagccaacaatatttgcccttagagggctgctgggaataaagtgttattatataagtaaagtatgtgtgcaatgctcagaacataacaaatgctcgaaacacataaatgcattcaatcaaattcagattttatgccaaaggggctcaccaattttatggatcctataggagaaatccagttctgcatactttatatgcattattatattttttggtccttctccttgtgcagggatgggcatactactgccatccccattgtcagatggagaaactgaggcattgagcagtaaagtgactcagcactaccacccagcccatacgtgtcaaaagtggcattggaacctatgcagtctgacaccaaagaccactgacataaccactgtgaccaagccatgctatccataagacttgtagagtaaatggaggcagctctattacttagaaaattcagatggggggttttagctataaataagccaaatgttttgacagaagaggcaaggatggggccagagcggccggagtttcaatagtcgtggtgggttgttccacttcatctgtctcgttcccaacagccacagagtcatctaaggggctgcagttacctccatagaaaactcttgcccctaacatagtctactccagtccatcggaagacatgtaggtataggtggccatagcttcttgttgaagatggagggtaagaaagagaaaaaaggccacctgaaacggaagcccgccatatttcaagtgcttaatttccatagtagacagtgtcagagtattggtctgatgtggaccaatggcatttggaggggttgagctgcgactgctggactcagagtgacgtgttaggctgcagcctggtatgggcagcactggcttggaacaccactgaggggctggttccttagaaccaagagcatccaactgaaagcccagttaagaacacacagctaagggaacccatttactcttctctgcttggtgcatgttctcttccttttttgaagaggaatttgtctttgtgccacattctcagttcctacccaggtaccagggttgtgtttctcccactgggcaggaggacgttcagaggtcaggtctgagaactgtgggatgttgcctgtgatgaggacagagacaccatctgacacactggggtccatgccacctttctgcctccactccctatagaagatgttggagaggagcgatccctcttctccaatgtctgcgacagaccaaagacaccttggcttcacaccatgagggctggagcagtgctggagctcaaaagaatgccatgctatgctggctacatgacaggctcaccccctgccaggcatcttagtggctgtgcgggtgccattaccttctccatcaccggcagtcctcaaggagcacaaatgattagaaatgacagtaattcagaacaagagggggaaataagacctcctctctgtaaattagcaaagaagcaaggtaaggacggatgtcacatgtgccccatgctactttaacctagtggtttcctgccatccttattgacagctctcaagagctgctacagctttcacaagtgtgtagatctgaccccattcctttagtcagtgggtctctcttatacctgcacaatggccttgaaagtccaatcctagccccaagactgtttactggcaaatctaattgtccctaccctggggaggactataccccacagtagaggcatggacacattagggatgggaacttgtattatcaagcggcttgacatttcctaatcaaaagtttccggttttagctcatcatcttcttatgcatgtttgcagatgctctctgggggtctcagcacatttaaaggctaattatatagttaaagttaattattcattcattaacattcaagaagcctttaacaagacactgcttgtcttgatgaattaatgaaaccagcatgtgcacatgagtgtgtgtgtgtgttactgaaaattaaaacatctctttgatgataactgaatatatttttttcagatcaaaccaaacccttgccaggaagaggaacacattagcacttgaggtcagttggcatgtttgggcaactgtggaacagggaacacaattcagatttatcttcaccagctccatgagtgaagcccggtcatgggacctctctgagcttcagtattctcatctgtaagatgggaaataaataataacttattacagggctggctgttggatggattaaaatggaagtgaaggtgttttgcttgtaattgcagatgctggtgggatttaggagattatctggcagtggtggtatcattatgcagagaagcagtggaggtgtggatcaccaccgggtacccatcggggaagggcattcatgatccccagaaatggcaccactgaggcatgacaagctttgaaattgtttacttgggcaagagacactcaacctatacagggactacctgccatcagcacagaatggtctaaaactggctttgggaaaatggcctagaatcacattttgattctgggtttgtgaatacaaactctaaagtcagagttataccaacattgatgaattttcacaaaggaagcatttttcaaagcaaactcccttaagctaatttaattcctcgatcgatgtcttgcatagcgtagttaaattgtttccaacttttttggaaacatttttactggggtcaattcttttgtgtttaaattttataaatatttgcttcattgatcaggatttggaccacaacaaattttactaatttataacttctgccattttgagttttcttttgtggttattatttccaccaagtcaagtccatttctcctgggtcaaaattgtacagagatccaaaattagctaagaagatttgagtcatctatggatttttagtcaataccaaatttcaccctgtgtgctttcagctcttgtcagtttattttgtgtggcttattttttttaccaataatattcactgtgaattgggcaaaaaagatggatggttaatatttatttttttagctgataataaatcctgagtgattttgtaagacagaggcagagagaagcagagaaggggagaggatagaagagaggaagagaactagggaggaggaagagatccagatggaaggaggtaccaagcaaaacatgaagacggagacagaaagagagaaaaacgatgagaaagagaaagtgaggaagagaaacagagaaggagaaagagatgttagtaaggtacagagagggagagaataaaaagtgagatatattgcaagaaactaagagaaaaaaggggggaaagaaagagagaaaaagaggatagaagaaggtaacggggaaggagtgaggacagtgatatggtttgtctgtgtgcccacccaaatctcatcttgaattgtagctctcataattcccacctgttgtgggagggacccagtgggggataaatgaatcatggggccagtttcccccataaggttcttgtggtagtgaataagtctcatgagatatgattgttttagaagagttttcctcttttacttggttctcattctctcttgcctgccaccatgtaagacatgcctttcaccttccaccatgattgtgaggcctccccagccacatggaactttgagtccattaaacatctttttccttataaattatccagtatcgggtatgtctttatcagcagtgtgaaaatgaactaacagagagagagagggagatggagagggagagggggaaaaagtggggggagagagggagggaggggagagagggagggaggggggagggggagggggagagggagggagagggggagggagagggggaaaaagtggggggagagagggaggaagggtggagggggagagggagggagagggggagggagagggggagggagagagggagggagggagggagagaaaggagagacagagagaaagagagacagagacagagagagagagaaagagaaagaatacccaagagatgaatgtacccactttgtctattgactgctaatttcaaagatagggaaggattgaaatgattgtccaagtccatctagctgtaagtactttgtttctgttaaatgtaacgttggacccaaactgactatacccaaggagttgagacagtatgtaatccagtctcttcatttttcagatgaggacactgaggcccagagatctccgcccaatttttccagaccggtctgtcactcaccaaagcagtgtgccttcaggacaccattgccgggctcccccagtgcaaggcctcagctgggatgcagggtcagagaactggctctgcatactttgtggaaagttgggaaagtctaaatatttctctaagccttgatttccccatctgacaggaaggaaaacataatctgtctcctatgtttatgcactggttgaatgaagtcccagccatgaatttgtttggtgaattgcaaagcactatgcgatgctgtattttcttcaccacaactcatgctctgacataggaacagtattggttctttctggaatgctactctttatagagcttcttagattgtacttttcaagggttgaggtcagacctaaccattctgctgcagatttcacgaagcatagcgtttttataatattagaaagatggctcaaaaaggttttctttgttcagacttttcttgaacatttactatgtgctggacactgcactctttgccggaatatctcatttaatctttacagtgcatttccaagtgaaggcagcacaattagtataattttataaaagtggaatactggagtctaagatgttaataacttgtccaaggtcccaacactggatgtcactggagtgggaattcgaatccaggatgcttatcctttaagcaccccatcatactgttagtagtgacgacatcacggaacttgtcacacaggaggactgaaagacagggactctcaggggccagaaaacatgagagtgaaagagagattccgaaaaacatcgagatttgtgaaaatgctattatgtgttagatagaatgcagggtactttccataagtcaacttggttatttctcagaggaattccaggaaataggattttacacatgtgggaaacaggctgagagaggttatttaatttgccaaaggtcacacagctggtattagagacagaatattaaagtaggcgtttcttaccccaaaatccactctctgcaccaagaggccactcagaaaatataaaaataagcaaatcaaataaattgactacgtaagtttgaaggcttcaagaaaatataaatacttccacccagaaattctatgtcctggtttcattcctagaaaaccacttgtagaggtacacagaggactccccaacgatccttaacacagccatatgactgatagccctcatcccacccccccaaaaaaagtctagtgagaagaaaatgcttaaaaatattctgatgcatgcatatcatggagttctttccagcagtcaaagagaatgaaggcaaaaaatggaaagctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgagatcagcctgggcaacatggtgaaaccccatctctattaaaaatacaaaaatcagctgggcgtcatggcgcacccctgtagtagcctgtaaacccagctactctggtggctgaggcaggagaatcacttgaacctgggaggcagaggttgcagtgagccaagatcgtaccactgcactccagcctgggcaacagagcaagactctgtctcagaaaaacaaaaacatatgcaaatgcatataataaaagtcttggagaaatggaacgtacatcaaacagacaacagattggcattgagatgccaagccaaaggaatgcttatctgtattttcatttttttttttttacaatgaggatacattttttaatgagaagcaatatagcataatggttaagggcatagctcctagagccagttcaaatcccagctctgaagcttaccagcactgtgcctgcgtcatgacttaagctgtctgtatagtggagatgctgggcatgccaacctcccagagaagctgtgaagattaaactaagagttacaggtaatacactcataaaagctgctggggccgggtgtggtggctcatgccagtaatcccaacactttgggaggctgaggagggtggatcccctgaggtcgggagttcgagaccagtctggccaagatggtgaagccccatctctactaaaagtacaaaaattagctgggcatggtggcacacacctgtaatcccagctactctggaggctgaggcaggagaatcacttgatcctaggaggtagaggttgcagtgggccgagatcgcgccgttgcactccagcctgggtgaatgagccagactctgtctcaaaaagaaaaacttcctggcatggagtgagggctacctaaacaactgagaccaggaggcaggggatagggaaggtatgggaaattggccagcacaattaccacctgatggtgggagttcacacgcaagaatccactttgcatacctgtgtgctgtgcattcctgtggaatacaccaccactccccacagcacacccagataaagtactgggcagcatggcctcttcccctggtccccaagacacctgaggacagcctccactggcagcactgatgtcggatacctatcaggaggtgatgttgggaaaaccacactacagcctaggtgagtatacctccaaattcatgtacacctgggacatcagagtatgcccttatttgaaaatcatgtctttgcagatataattgtttaaggatcttgagataaagtcatcctggatttagggtgggtcctaactccaacggctggagtccttagaagaagaggagacataccaagggaagaaggtcacctggagatggaggcagagattggagagatgcagccacaagccaagaaacacctggaggcaccagaaactggaggacgcaaagaatggccctcgcttagagccttcagagggagcaaggccctgctaacaccttgattttggactctggcccccagaactgagaataaaattctgttgttgcaacccaccatgcttgttattggttatggccactctaggaaactacttcactggggacacctgaaggtgcagtacctgagttcctatcactcctccacctgcatttctctatgggaggaaggaggtggggcttgctttgggagaggcagctgtctggggttggccccgggcactttccatggggtgtaaacagtgtctcctaacctgtgttagaggctttccatggtctgagtgagcccagtgccaggaaaactcacttctccctgcagcaagagaacacacagggctgatacattaacaccatgacctttttagcacctgggtcagtggagatgtgtttataattttactgtggggagaaaggaagctgagctattccaaacctgtgatgcttcatgggtgagagcaacttcgcatctcctaaccccacgaccttgtaacagataggtacaacccttgccagagctgttcccttctcaggacaagcagagggttagcacaacatcatgggtcagaaaagatgttgggtcttcaactgaatgctggcactgctactcattagatgttaaccttcagacgaactgtggcttctgcctgaacttcagtgtcctcctctataaaatggagaaaatgattatctggcagagttgaatcaggaggaaatgaggtcacatgtttgaagttcccatgtgagttcagcaagcaataacaagaggtgggccaggtgtggtggctcatgcctgtaattccaacactttgggaggccgagacaggcggatcacttgaggtcaggagtttgagaccagcctggtacaacgtggcaaaaccctgtctctactaaaagtgcaaaaattagccagacatggtggtgcacatttgtggtcccagtactcgggatgctgaggcacgagaatcacttgaaccctgcagatggaggttgcagttagccaagatctcgtgactgcactctagccctggtgacagagtgaggctctgtctcaaaaaacaaacaaacaaaaacaaacaagaggtgatccctaaggatatagaacctgccagggagttcctgcttcttcacagttcttccccaggaggaattttctgaccatgtgcttcctgtggcttggctcgaatagaagaaattcatttcctccacgctcttgctccacacattcatttattttccttatctcaatggaagaagaaacattgccccttttgaaacagtagtaaagattttaaagaaaaaaggagaacttttgaagtaaaaatatgacgaaattggtactaggttttgcataatggtgggccattagaaacggccttaattgtggaatattatgagaacagtcatattttttattttttttacattgtgactcaaagcaggggctctggcgtaagattgatcccagacacgctgcttaatctctcaatgcctgtttcctcaaaggtggatgaaaatcttgatggtcaccgtcatataggtttgtcatgatgtttaaattagataatggaggcaaagcatttaacacagtacctggcactcaggtaagctcccaataaatggaatctgttagttagaaatgcctcacttaagccggtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccactacttgggaggctgcagcatgagaatcactcaaacctcggagatggaggttgcactgagctgagatagtaccgctgcactccagtctgggtgacagagcgagactctgtctcaaaacaaaaacaaaaaagaaagaaaaaagaaataaacaataaaataaataaaaacacacaataaaaaaatttaaaaaacaaagaattgctttgtgtccaaagcaattcaggtagctcacactcactgtaatagaatagaataaggtttacacatacggataaagcaattggagttaagtgaattcagaagtggaatagtagctcagtcttagggaaagtcagtaaacagattttcaggccaaaggctccacaattgtgaaagaagaatcatgcattaagctctgaattgtgcggtaatccaagcaaaaagaaaaccataagttgttataagaattgtgttgtcaacaagatcaaagcgtgcctcaaacagaacaaagcaatgctcttcatcgtacagaagtgtgagggatgctacaggacgacattctccacaagctgtcctgtaataaccgtatcagcaaccttttcaaaaataactatttcttgtagtacccttcagtgctagttaaggcatgatgaaaacacaaagcagtaaaagctaaattaattaatattcctctagctcaatgaaattatcacctggtccttaaatgtggaaactaaacaacagaactgtctactttaattgagaaaagcaaaacaaatttgcatatgcaccgactcaacttgtatgaattgtatatatgcgttgacaatacaagaatgaaatgcaggaaaaaatagagaattatagtcagaagaaacttttttctagctattgcaagtaatactgtgttgctgaaaatttgttaaatgtaaaaagatgtaaagtccatcatcccaatcacctagcagcatctccgataacattttgatatatttctttttagtctgttttttttgccttttttttttttccgtctctgagtttaaagaattatgatctcactttatttaactcctgccccccacagacatttttttctactttaaaaaaagtttttataggtggccttgaaaatcctttaacgttgttttaatagagcttaccaggaaataattccaagaaccccacccccccgcaaaaaaaaaaaagatgtctgtgtttacttgagtttttattaaggaaaaaactttctaactctatgatgtggaagcaattatttttgagctttgtttgcagtgtgggggtggatctcagaaaccaggtcattgttgatctgattttctctggagatgacgctaccccatttagaacagctcactgaaccctgatgtctatgcccgctttcgaattcagcagctggaaatgaaccatttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttgagcatagaaatgataatgctgtgattttatcagttctcagatcatcaattaatatgatatgtactctataatatatgcacatatgtaatatctaactttagttttaaattctcccctgaaccataaccccgtatttccaactgcctaggtggcatttccaagtggggaagtaagcctaacttctatacttactaattctgcaatgtagttacttagctgaatagcctattgggtaattaggttaacattgttgagcttcacattcttcatctcttaaaagggatattaatggtacccagatcgtaggggtgttgtgaggattaattgagattaggcatatgaagtgctcaggtctgtagctcactaattgtcaggtcacattaagtgcaaagatgcctggacatatgatgatggtgttccaaaggcacttccaacttaatatgcctaaacctaaactcacattttgccacatctccacccatcctgcaccctccttctgaaatatcctccctcttccttgtcctgtttagtcactacagaactccatttctcaatagtcaactaactaacctctcaaagacatggactacctacatctgaatcactagaagcactaataaaaatgtaccttcttggccgggtgcggtggctcaggcctgtagtcccagcaatttgggaggccaaggcaggtggatcacctgatgtcgggaatttgagtccagcctgaccaacatggagaaaccccatctctactaaaaaatacaaaattgacagggcatggtgttgcatacctgtaatcccagctactcgggaaggctgaggcaggagaatcgcttgaacccggaaggcagaggttgtggtgagccgagattgtgccattgcactccagcccgggcaacaagagcgaaactccgtttcaaaaaaaaaaaaaaaaaaaggtacattcctaaatcccacaggctttgcaaacctgtgctctaggataggaattcagtgctcatttgtttttcaatgcaaaactttctatgaagacatttcaaacacatacacggagatgggactacactgttcttttgtttttacagacatgtcactgaggacaactcaagccttttagaaaaatatttattggtaaaaagacaatactccctaaatttttttttaaatgtgcatcaaaagacactatcaatgtaatagctagaatataaaaaggtaacccatggaataggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctcgataccactaatcattagggaaatgcaaatcaaaactgcaatgagataccacctcatacccagtgggatggctactattagaaaaacagaaaacaacaagtattggcaaggatgtggagaaattggaacccttgtgcactgttggtgggaatgcaaatgggactgtggaaaacagtatggttgtttctcaataactaaaaatagaattgacatatgatccaattatttcacttctgcatatataccaacaaaaaaaaccaaagtctcaaaaatatattcacacatctacgttcacagaagcatgattcaaaatagttaaaatgctgagacaactcaagtgtccattgaaagatgaatggatgagcaaaatgtggtacctgaatacgatgaaatactgtttagccttaaaaaggaataaaattttggcacatgccaaaacatggatgaacattatggtaagtgaaataagctagtcacaaaaagacaaataccgtatgattccacttagatgaggtacttagagcagtcaaaatcataaagacaaaaagtagaatggtggttgccaggcgctagggaaaagggggttgaggagtttttgtttagtggatagagagttgcagttttacaagataaagagctttggagacagatggtggtaatggttgtaccacacgatgaatgcatttaataccactgaactatacacttaaaaatgtgaagatggcaaattttactctatgcatattttatcacaataaaaaatactgggaaaaaagacaatcctctcttccaattcttctaactactgcatgtaaaggaaaccaacagagacctgttttttaacattgtgctgagaatgaaatcgcacaggggactggggatcctgagagctgaaaactgaggcttctaaggaaattgggacttttccataaatgtatacacccagacttgtacatgaaaatcaattaaaagaaaaacacaaactatcccactgtgtcttgaaatattaggctcttcggagttctagggacgttgtttaatttaaatctggcatatgtgcgacgcttgcagttttgcccccatgccaaaatggcttggaggacatcagcttctgatgactgagcatttgtaaatctaaatctgtctccactcatttcagcttcagctccctcttctagagtggatgttcttaaaatttgattagggcatatcggagtcacctgaagagcttgttaaaccatgcagatcttcagacccctccttacagagattctgattcaactggctcagtggggctcagcaatctacatttttattagcacctattctgattcagactcaggctatgcttgagaagcattagcctagaaacctggggtcactgacgctcatccacctttggttcacaggagtcccacaaggcacaacagatctgtgcctgaaaaatcccatctctgttgatgtttacacatcaaacccttttttctcactgatttgtctgataatttctttatctccatttattatgaatttcaataaacagtaaaacttagctttcaagtttttctctgcctatgcctttcttcaaaaaattagggattccaaagacaagcatttggcttgtctactctgtatatgcctatcccaataaaatgtgtttcttcaactcctttaaaatagtagttctcagctctgttgcacaatgaatagtgtgttggacttctaaaacagtagttctcaaatattcgtgtgtctcaaaatcacgtggtgtggcgtgctgcggggaatgatgcttattataataaagattcacaggctccatagctagagagaaagccttgtcctgggcccaggaatctgcattttgacaggtaatcatgtgattcaggtacagttggtccattggccaggcttggaggcacccaattttggggcatgattctaaatcctttctgcaaaactgacagttgtttgcatatgtggtttgtctgagtcttcctaagtgtttgacacagataaaagaatctcatgaactagtttagagatcaaagaattcaaccatttcacttcttagatggggaaactagaaagtgacttggagaggtgacatgacttgtcccaggacacagctagctaatgctcgagtccagactcaaacccagctgggactgtcacttgacagtaatccaaagcctgtctggtgttcaggactctcccagaaaattacaacccacaatttcactgaccctggtgtgcatgcacgtggctttgctaggcagcagatgttactgaaacgtgtgggtggagcagtgagacccagcagctgagccacatgctctggatgttctaagtcaaggcttgctggattctagggtgttgggggaatgttcaaaagctgagcaattcgggagcagatgaggttaccttcttcaaccttccagagggatggaaccttctacagatgctggtcgtggtaaaggacgagaatgactttttttttttaaggctcggtggtaggtacaagaagatttcattgtattattattattccttaaacagcaatatatttcataatgaaaattttaaaaaggaaacaggagatgtgaaaaggaaggaaaaggcctgtgagtgtggtgacgtggacacctgaaagaccgcagtctcgtggtgggacgttgagaagacacaatcaacacaaagttgatcggatcttggtgtagctctgtggtggtaattctcatattctggttttcataatcatctgaggagttgaagtcatgtctcataccacccaccaagaaaaattccaaatattaaaaaatgcaaccaaaaaagaagaaaacacgaggtaattatcttgtaataaagaatgatgaaagacttttgaattacgtctcaaaattcaacagccataagcaaatggttgatatatttcactacaaaaaagataaaatctgcatggaaaaaaaaaagcaagctcaaaagactaaaaaagaaatagggaaaatatttgtaatcacatcacaaaaggctcatctgtccaatatataaattaataagaaaaagaccaacaaaccaatagaaatattaataaaagtaaaaaaggaattgccgatggctcttaagtatataaatatggccaaaatttactgagaaaagtgcaaatttatatctcagcatactttttacctattagcaaaattttgaaagattaattacacattgtattggcaaaactttggagaaataagctctctcatgcactgatggggtaagtatgaatttcctttggagggagatttggcaatatctgttaaaattgcaactgtgacccactctttcaagaaatttattctacactgaatgtgacgcaatacaaagatattcactacagctttgtttgcaatagcaaaagattggaaacaacctaaatgtccaacaatagaggcctgaccaaataaaatatggtatatttgcataatgaaagattatgactctataaaaaataactttatggctttttatgcattaatatagaaagattcagaagaacatattggaaggatacacagagtaaatgtggttaccatggaggggtactagatgaggaatagtgtgcagggaaaacttttcactgtttttttctttttatgtacttttttatttttgacgtatataaatatcttatctattcaaaatttaatttaggctgggcatagtgactcactcctgtaatcccagcactttgagaggctgaggcaggagaatggcttgagccttctgaatttgaaatcagcctgggtaacacggcaaaacctcatctccacacgaaacacaaacattagccaggtgtggtggtgcttgcctgtagtcccagctactcaggaggctgaggtgggatgattacctgagcccagggaagtccaggctgcaataagctatgattacactactgtactccaacctgggtgacagagtgagaccctgtctgaaaaaaaaaaaaaaatttaaataattaatcaaggagcctgttaaacatgtatgtggtttccccaaatattaactccaatgaaattaaatctccagtaatgataactgctgtgctttcatccctaagagtatattgaattattttttaaaaaatgacttgtggctgggtgcagtggctcatgactgtaatcccagcactttggaaggccaaggcaggaggatcacctgagctcagaagttcaagatgtgcctagtcaacatggtgaaaccctgtctctacaaaaacacaaaaattagctgagtgtgttgagaatcgtttgaacctgggaggtggaggttgcagcggggagagactgcaccattgcactccagcatgagcaacaagagcgaaactccgtctcaaaaaaaaaaaaaaaaaaaaaaaaaaaagacttgtactccttcagctctagtttctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaaaaaaaagattgaaaaagaaagaaaacaacccattttgtgctctggttaataaatggagggagagaaagccagctaggcatcaaccactgtctccaaccattatcatctgcatttgtgcgcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggacagagacatccatgtgtgctgcattccagcaatgagaatgaaagcactgaaattacatgcaacaatcttgcaaacacaatgttgagccaaagacgacaaaaaagaaaagagtgtggctttatttctatgttaaaacagcaggcaccaagaatctacggctttagaagtgcaggtggcgggtggaagatattgactggaagagggtgtggggcggggttccagggagtgatgacctggatgatcagtttgtacgaagccataaagcagcatatttaatatttgtgaattttctgcatttttgttatacttcaaaagtttaaagaaatcattccaaaccagaatgagcactgtgggaatgagtttttcagaaatcatagacttaacttctgaataaatgctctcccagcccctgctgagatgccaaagacattccaaaggcacagactgaaaggacagaatgctcacagccaaaactaccgggatttctatgcagaaatctgggctttgatgctttagaggggcctctgtctccccctaccagacacaaagccagcagcaaggccttcacaatgggcttgccgaacagccgaaaaggaggttatttattaagccacaaggagaatgcacctacagtcatgtttccatgcaggaatctgtgacaactgaaatgccccatatgagctaattttctggataatcaaaatcccctcattaaacaactctgtcatttaaaataaaatcatttttattggatttaatcctttctaaaatggatttcatgcattcctgggtctacatccaggacacactccgtgcttcctacgagaatgattcctagcaagactttctcccagagagttccacatgcaagcagaaagaaaccaatgtgggctttagcaaaggaaggggtaggacagacgtctccattgtcagcaagaccacagaacaatggacttttcagaagagtccatggaatagaatctaacctttacaataaataacaacactcacatttaggtactgtctatttcccatccaaaaggctttccatcagattttctctcttaggtcctattattattcccatgttagatatgaggctatgaggtatgagaaactctctctccaaagcctaaactcctaacccctgtgctatcttttctttacatcttcagctatggagtctgtgttacactccacaatgccaacagacagagaggaatgctaactgtaacttgaatgatttgagttctcattgcttttctcccatcttttctttctctttcatcaatgttatacaattagttttttcataaagctcctactagcaagctactcctccccacactcagaaaacctcctacctaaaatctgataaaaatctttgttttcactactttaaactcttggccttcttggatctttctatttgttaaaatatcctatggagttggacaaacttctttatcagtttaagaaacccctctgtttctgtgcatttcaaagcatcctggatttgctttttcttcacccaactcagaaggaaacctgggatgctcattagattaacaaaaactgccctcaactggggcccatctggaccacagtcactctccagaaatacaatgggagcagataggaactgaggcatgccgagagtcaatttctgtaaggtttatcgctcgcagacctgtggtgaaaaggaaactgccatccttaccccgttttcaggctgaccaaggcgtcctctactcctttctgattaaatttggtcatgtactgatgcatgtagggatagttattccgaatgtttctctccgtgcttccattaggcactgtcccaaatcgaaaaggtggggaatagtcatgaggtctctgaaactggagagagaacgagaaaggaagagagagagtaggaaaagaaagagaagggaggagggggaggagagaacaaataataaattagtgatcattttgtctggtgttaggaggtaaatgcatgcattagggcaggatgacaataaaatgttgctttttggtctttctttctacttagtcacatcttcagccagtctgtgagctccaggagggtggacacagcatctgttttcttctgtactactgctcagatcctagcacagagcccggctgggtgctccataggtatttgttgagttgaacttttcagtgccattacagagactagcacagtgttaggcacacagtcagtacttagaaatgctgaatgagctgaacttaaggtactaccttagtccagtccatttatccactttatgatgaaattttctgtgatctccaccaatcactcccttctctaaactccatttataattaccttcacctcacccagaaaatgactatatattaccactcattcattctccactcactcagtcattcattcactcctgcaggcactatttatctagtgcctaacattccccaggcataattgccagtgcatggcaggctccatgaatacttgttgagccagagtccctgttgatctttagctatcagggatacgcagcactcggcactcaagccccccataaaggcctgtagtccatgcatcaccagtcttctctgatggattggatgattctgtctgtccacagcttcgatgtttcaggtgactcaatgagagtcgaatcaatagaactggatctgagttccagaaatacagctaaacactagagatggtggcgggctgtggttataagcaggagctcgaactggctggttggaaaattgggttctatcacatacaagctatggaaccctagataacacattcacttcatgctgcctccatttattttccatctgtagagtggggggccaccatgaagatctcaacatacatttgtcaagtaactggaatagtgcctggaccagagaaagcattcaaaaataaagctatgattaccgtctgttattatcattatgagtgaaaaaggaacctgaacctcatttttctatgaaacattgaattctggaactagaaagtaataacaacaatgactaacactttttgggaacctagttgggtccagcactatgccaagaactttacaaacgtcaggtcatttaatccttacaaacccatgccaggtagttaatcttagaggctgcttcttgcagataagaaaactgaggctcagagaggctatgtgatctatttaagattatgcaactaccaagcagtggcccagaattcaaacccggatgcgtctgaccacaggctgaggtcttaactctatcattcctcagagaccattgctattgactctctcctcatctagacataaagatttaaagaccccaggaggggaagagcacccagaaaatcagtgtcagaaccaggaccacaatgcagcagtctctccaacttccagaccagtgtgtcttccacagaactaagaaccgccagggtaagtgtccaaatttacccaagagtcaaaccagctagaaacattattcttttttccagactcacacttcacttcactgttaattaaaatttccagttgaaaatcgttttccctaaattaggcatgctgctgcctaatatgcagtcataactggatttgggagaagtggccatccattttccaaatgagatcctcctgccagggtgtgccttgccctgggagtatgtgcgtccacgtgtgcatgtgtgtgtatgtgaacagcaaaatgctttttgcagtcactccaccaagcagtgccttaactaatcaccaaaagctcaaaaggccaagcccaggctcatcctcatggcagccgcctgctcgggaggagagaggtaatagtgctgttcataaatctccttgtagcagccattcccaatctccagagatatccggagatggcctatttgactaaatgccttccacttcactccccgtctgttgcagaggagctgcataggtctttaaaaattcactttcttccctgtgtctgggttgcacagtaacagagatagatattcagtctctgtgatggtttccgtgcttctctggcctggatagtaccatcacccacacaaaattcagcctgacaccaagctccaggaaccttttccactagactgaagactgtcaaactttttaaagcatgactcacaatacgtttcccatcaccactccatgcacatgtgtgaaatttcacagcactcattctttctatctgtgatatactctgaggttatccattatgttctatttttttaaaaaaatgtctgcaatccttagattaatttcatggctcactaaagagtcatgacctacagcgtgaaaaacagtgagggggcaaggatggctcatctattaagtcccagggtctacatccaggacacactccgtgcttgctgcgagaatgattcctagcaagactttctcccagagagttccacgtgcaagcagaaagaatccaatatgggctttagcaaaggaaggggtaggacagaggtctccattgtcagcaagaccacagaacaatgtaatcacaatatctggagtcagaggaactcccctggcttctctgcagggttcccttgctgtgtaggttaactggtttcacctggctttggacttacaggagacaagttcaggttctcatctgctgcttagaaactgcgccatttggagcaaccagttaagctcctgagcctgaatttctctatctgtaaattggagattgcttttgcaacaaatcttatagtgtttgaaagaacacctggcatcctctaatgcttgggatagatcacctgttgttacccacgacatttcagccaaacaatgaagcctgtctccttacagtttggagaacagaggattattttctaattttttttccatccaatatggaggcatgtctgaaggtcatccaagtgactaaaacatggcaagtatttgatgatggaggaggtagagatgcaacacttggagataaaatttccagaaaaatgcagcaattaaccaagatattttttctttttttgtgaaccaaaaactacccatttattaaaaatatctatctgtcttctgtgcctgtaaataagggacatctggcaactggagcccctatttctagtacagtcttctgttggtgaagtcccacgtgcttcttgatgtgagcagcaagcaggtgtgtccttgagcagagagaggatcagctgggaggaggcctggctgcctgaactgggaccactcagcagcagcagcacagtgcccagagacagcatggctccttgagaacacattcctgggctcatccactgagagcagttgcctcaattccctccattggttgtcacaaaagaccaactcagtgcaataacatttcaggccccagaagccaagaatggtttgagtcaggcgatgatgaagatgatggaaggagtaggaggagaagggagacaaagagaaggagagggggaggaatgagaggggggagtggaaaggaggagggtagaagaaggaaataacacattacaggatcatctaccatgtgccaggcatggtgtgaggattatttctaatcctcctatcaaccttgccagaaaggagataatgtcttctcttttataggaaattaagcctaaggggatactgacatacagaaggccaatcatatggcaaggccaggatttgaacccaggtccatttgaccccaaacatgatattgctcttcccacaacataaatctgcctcccagagatggatttcctctgtcagagtgattcccaacattttggaaagcatccctatcaacattgcaattttctcttaataattcctagggaagcatcttacccatgaattcacctatttataatttaagtcccagctcatctgagcacaccatgggctccaatatgattatttcacagcaagcactaatggcttaaaagcattgtaaacctgagttgttacacaggtattcatgataaacaaacaacaaaaaaacaaaaacaaaaaacaaaaacaaaaccaaccacagtgtacaataaattgattcaatattgatttttttttgcagactttcttggtgtatcttctattaatcttctgggagcatataggttatttactccaggaattttgctgtttatctcattgtatcaaacatttaattaaaagagctatcagcttgcctctaatgttttcagcatggagactgagctttgtctcttgaggatatggtatctgttactgggtgtttccaagtcagtgaaggtcagtcaaattattagtggttttaattagttttcccacaagtggtcatgttatttagacccaaaactatgtagtaaggatttccccccgcccttgcctttgaacatagcaacaaaaagcaaaatatgctgccaaccactttcttgaaaaatcctctcttccaggacattgcttcctgctgcttccaccatacctccaatcacttctaggaattgcacttttgatcccataatgcgacagacttgcacaatagcgcttcatgtctgcagagggattcatatgctacaagatacatttacatatgtggctttctttcatccttactgcaattgtgactcccaaatttacaaagcagacaaagcaggcaccgtgaggtgacatggctttaaaaacattatacggctggctggcgagtggcagagaggaaacaggcagagaggaaacacaacttttctgactctaaacacagtgtgttatctgctgcctctgagataccacccgctttaggcggggatcttacagtagctgaccccaagtgaaggatttgggggtgagcatgatttactagtgaagggttccaggagaagtcagcaggggagcaggataaagttaggaaagactggagaagggggagaaatcaagggtctgatttaaggccaagtctccatctcagtcccgtcctgcagggagctccagagagtgattcgtaccttaaagtttttcctgcttcgaagcaagggagcagcttagcctttgtattctcacacagattagtctttggttacaggtgaccacaaagattgagggaacttaaattgccaggcatttaccattccagtgcccaaaggcaaaaatctgctgaggatccctgaagtgaggctttgtcagcaaagcacagaaaggtggggctgggcacacagcgctgcaaaagggatcccaggagatccaggtggggtatgcacagtgtccagtataccatgcatgtattcattcacccagcaagagtgtcctgagcacctccaaagtgcaaaataactctatcaaaactacatccctgagggcctcttcccccagacaattttagtctcatcagctttatcttctttataatacttattcctgccccaaatttccaaatttgtttcttccttgatgtttacttgtgtattgcttatttttttcctactagaatttaagtttcttgggagcctgagctcattctgccaagtttattacagtagccaggaaagacttccctgaggaggtaatgtcttccctaaggccagaaattccaggaggagccaaccatgagaagattggggaagaacattctaggcagagggcctaagaggcacaaggacactgagctgaaataaacttagtgacagggatggagcaagaggaaggaaacgtgggagcaggtgagataacacagggctttgtgtgccatggtaagtaaagtgacccttactcaagcctcaatcggaagccatcagagagaggtgaggcactctcatgcctttgtggaaatgactccatctttaaccccaacccctcatcagctctcttgacaagattctttcaaccacagtgtgtatcatggataagctgtaaaagctttccatggattgattttctattcagcagtttgttgatgaatggcaaaaggatatatgtagacttatgtcaaaaagatatgttagcgaggttttataacgagagacaaattatccccacacacagaacagaaaatctttgtggtgctgcaatctcaacacttgctgagcttagcaagtcaggatgtttcctgaactaaagtctcaataggaggatgcacccagtttacctcttttcttcctcaatgtgtgtttctgaatagctactcaaaccctgcaacccttgttatatttcatttcactggagaatgagagagcaggtgtttttactcctgtcttactgatgtgggaagtacagccctataagggaagattagtgatatatctgagtagaaagaaccagtgggaaattaaaaaaacagaaagaaagaaagaaaaaaactctctgctccttttgtgtgccttgaagacatttcaggtgagtcagaagcgctgatgctgagactgatttggctgtatggaaaagaggagctgtcagataattttgtctctgggtagggcttaaagatgactttttttcaggtcatagatgaggtacccacagcctacagtgctccttcaccccaatttcttctcatccaggaaaatgggccttccttaacatcacacattcgaaaggatgaatttcaacctaagcacttgagtcataggtcattcacaagcaccatcagaaagatcatataaataggaaacacgaccactcggggaagccaggcttccaaattagatctggaatcttttaggtctaggagagctaaccttaatgttctgtttcaaaaactttgagaaagaggacaatttgagttaaagagaaaaaaccttctggcttttgtgcattcgagttgatggatctcaatgagaggcacctgaatctcttcctcctgaaaggagagcagttaagaccaaccctcagatggagaggaaagcaaggtgaccttacctttttgtcactgaggccggtcacttggtccacaaattcctcttggatcatgaaggcagccagattggctgtgtagctagccaggaatatgacagcgaagaaggcccatacagataccatgatcttgctggtggtccctttaggattctggacaggcacggagttattgaacaccaggccccaaagaagccatatagcttttccaattgtaaaagaaggcccatggggtgctgcagaagatgaaaaggacattctcagcattttctgaaaaaaatgcctgtttgtgtatgacaaccacgcagcagccaccagcagcaccgaaggttgccagaagatggaattatatcatagttgtgtcctgtgattgccctagaaccacaataacttatttttttctttaaaaattagcattcttctcacatttctatctaactggatttttgccacatttctttaaaaaaagaaaggaaacgaaaatggttatgcaaaatgggggtttgaataagtagtgttatgacctgttttaaatttggatttgattcccatttgaggaaaccagccttcttaataaacataaagagagcctgacaaaaatgtgtgcatggggactgcttccaaattcatcggatgtgctatcgtataagaaccatgcaattcagcgggactgatgtttggtattctaatccgattgtccctagcaattgctcctgttcaaactcagatgtaaagtgtgtacaacataagaattaaaccaaactaaaaccctctccaaatggagacattaaggaatggaacaatagatcttaattcttccaacacttcacagatggaagacatttcattgcagggtcatggaaaatgaacactgatgtcatatcacagcactttttccagtatatcctcgcaatagctatgcagcccttttaagattcttaaatgttccttgcaacagacttaactaaagagacagaatgatatgccaaaatttatggcgatggggcatatgcaggctgtaaaacacacatattagggttttcaagtctttgttctgcatgggcaaaaaaaaaaaaaaaaaaaaatcaactgatgccctaatttcatagggaaggtttccctttaacaggaggttaatttttatgtcatttaagtaaatgaagatatgaaaaaatgatctactcagatgtcacctgccaatataagcagagtgggcaataaataaagtggcagaagcaaattcacattaatggaagttatgaagtgctgggcaggaagcctaggaaaagcaagctctctgcacattggaggccaaacccaggctacagctgtacttataatatccatgacacaacccattaaagagaaagcagttaattctcttattctcaatctctcctgtttctatttggctagttttgtgatcttctgggcttattctcaagaggcaggaaattcttggggaaaacttagagttaatccagtcaactttatgaacgatttagtttttttagggatgcacactgatcagaaatgacagctatttaggaatcagatgtaggcagttcagaaggatcggtccaagacttctaggaattcctgattcatgaatactatgactgggccatataacttttcccataaagtgcagcgaaatgtaacagaaaaccattttgtacaaagaaacaagtagctgtcatttcccaagagttgccacagcagatgagctggaaacagagagcctggagagaatggaagggctgaggagtttgcacaactgatgccatcctttacaatagtctttccagcatgcttcaggcaaaggagaacgtattgcaaggatgggctgtgggtggtttttaccttccaaaatgtaactcagatttacctgattatctgtattttcgttgttcttgacaagttccaagtcattgcagtcctttctcttggaaaagtgacaccttcttaactgccctccccgtccccgcttccaactgttgtccccacacactatctggatagagtagccccagtgacctttttgctctgtacatgtatgtcacctgtctccctgccattgttttttttttttcttttctttttctttttttttttttgagatggagtcttgctctgtcactcaggctgcagtgcagtggcacaatctcggctcactgcagcctccacttcccgggttcaagggattctcctgtgtcagcctcccgaactgctgggactacaggagcataccaccacgcccagctaatttttgtatttttagtagggatgcggttttgccatattggccaggctggtctcaaactcctgacctcaagtgatctgcccacctcagcctcccaaagtgctgggattacaggcatgagccaccgtgcctggcctccctccattgtattttgaagaaagtctgacatgcttcccatggtcaattgcctatctctctgatttcatcttatactattgtctacctcattcactcacatctttttattttattttttaatagagacagggtcttgctctgctgactaggcagtgcagtggtgtgatcatagctcactgcaacctaaacctcctgggctcaagtaattctcctacctcagccttctgagtagccgggaatacaggcacgcatcatcacgccaggcttattttatttatttatttatttatttatttatttatttatttatttatttattgtagagatgaggtcttgctatgttacccaggctggtctcaaactcctgacctcaggcaattctcctgccttggcctcaaaaagccttgacatcacaagtatgagccactgcaccccctcagcctttttctgtttcttgagcatctcaagattatttcagcctttctgtttgctgttccttttacatgaaatgactgtaactgtttttgacagataaaattgtatgtcacccttcaggtcctagctcaatgaacatcctttcccattggaccatcttatctaacgtagtgtctgcaccccatcactatcatgtcactatgtttttttcttcttcttgatatttattataatctgttattattagtttgtgtgtctacatgttattttcacaactaaattctaaactgcctgatagaaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatcttcttagaggttaaattaccctttaaatgaaggcttgcaatctcccattaaacacaacatcattatttatggcattgtttagtatctggttgattgaagatggtttatgtggtaatcaccactcttcaatggtgaggaagaagttgaaagatttcaataaaactaggttcctaatagattcccatgacctgttgagtatttccaatattaaaacatctaagtgaaaagaatatgtatccatcacattaaagtgctctgctttttgggggatatgagacttcaagttccatcctctaccatatcaagtcattttttgggaaagagatttggtcctgacacttttctgataacacccatttagaaggtagtgcccactgaggaaagcccactcaaaatggcataacgtgtatgacataaaccctggctagagtgggatccttttaatgagttatagctaacgaatgcctcccaattttatttcctatctactgattgtccctttatcaactacaatgcactaagatcaatgcattttattttagcacacttgatttcctcctggcatcaccaacaggaaaatataaccctatggggaaatatatcacttcatagttatatttattgtcaaactaatgtaaattgattcagtagtttgaggaatgttcttaaactagattttataaagtcattttctttgcatagactgaagttgaaacccatgacaattttagcatttgacaagcattttttaaattaattgtcagaaaagttccttcaaatctgctttcccaacaaattgaacatcagtggttttcacctaacaactattgacttcaggttatgacaagattaaaatatttcattttgttttatccatcagttgaagtacataaaccatacttttctggtattacaagcaatatcagtgacccaaaaccattcatacaatggtacaccaacgcagtataatgtattctttgtgtgtgtgtgattgagtctcgctctgtccctcaggctggagtgcagtggcacaatctcgactcactgcaacctctgcctcctggttttaagcgattctcctgcctctgcctcatgagtagctggtattacaggtgtgtgccaccatgcccagctaatttttgtatttttagtagagatgggtttcaccatattggtcaggctggttctgaactcctgacctcatgatccacccacctcggtctcccaaagtgctgggattacaggcgtgagccaccatgcctggtctagagtaatgtgttctaaaactgaaattttcattaaaggtaaatgaaattgcaacaacattgaatcatgctcatgaaggtacccttacctttccctttggctaagtttctgttgtatccaacagggctgaagtattcaaagacaaaaacagctatggcagaaacaatgagcagcatcacaaacatcatcacccagacagaggcgctgaatggttctgcaaataaacagataaaggaatggaaacgtggttagttatctcttcctcacttccagcaggaagcccagacatccatttgcaggctcgccaaaaatattttctctaatttgaatctgatccttcaaaagaagctaatcattttttatttttatttttattttttagatgtagcttcactctctgtgtcacccaggctggagtgcagtggcacaatttcgacttgctgcaacctccgccccccaggttcaagcaattctcctgcctcagccttccgagtagctgggactacaggcatgtgccaccatgcctggctaatttttgtatttttagttgagacggggtttcgccatgttgcccaggctggtctcaaactcctgacctcaggtgatctgcccacctcggcctcccaaagtgctgggattacaggcgtgagccactgctcctggccagccagacattttttattcatcattttaaatcattctttattctacaaaatatttgaagtataagattgcatataatataataaaaatagagaagagcataggacattttacaaattaggtcaaggataatcagaagaaaaaagagtgataagaaagagggagcaagttagaatgcaaataaacaggccatagtttcctttgtaattatagaaccatccagggggctaaagctaggaagaaaaaagactagacccaaatagtaaaccataggctcctgcaaattgttatggtttttatttttattttttcatgctagaaagatgatatgcagggaattccaaaaataaagggagaattataacctgttggaaaagaattataaaatcatgggtgacagaaatattggaaagttataatctaccacactctccatttcaccttttgcctcagatagatgagattcctacagctttattaatcttgttgatgttggtagcagccttaaatgcaattgaaagtcaattgaggatattatcttcacatgataattcaataaaaaagcatcacttaaagggtagaggcaataaaatagtagatggatagatggttatttccactaaaagtagttttcatcagctcatttgcatgtaacttaggcagtaggtggatgtcttagaagggcaggccaagtcataaggctctaagccttgtaacactctagaaaggtaagaaatattatgtaaaataagattactattcaacttgattgaggatatgaaaattagctgactgcagccattttatttatggtatagatttgctataaaatcaacagaaaataaattttaaaaatgaatacatctccacctgaatgtatcatggggaagaaattgcctatagacaccaatgaacttaaaacccttttcctcataagcaaatattttctgagggttaaaataagtccaataatacttcttgaatagtaaacatattattattttaaaattgttttcctagtgaagctacttataataataaagagctaggttgatagcaggccaccttcttattagagtatgactacttaacacagctagaggtcaccacaaattccaatttaatgagtttaatgtataacaagaaactaatatgtccgaacttaactttagctatattggataatttaaaagctgggaggaatgctttctaatgcatttgatagtgcaaatatattaaaaagcaacaggtaacacaacttacttaagtaacacaagatgcgctccaagaaatcaatgaaactgcaactgaaatttattttaactttagcttgagtaataaacaatattatgtccctgaaataatagcaatttaatactgagttgtatccaaaaaggaaattagataaataaatgattaggagatttataagtacttcatattcaagaatagagataaaataattctccgagttgcgtagtgtgtcttattggaggaggatcattatgatgagcaaataagcatatacatgaaagtgtttgttcgtgtgtgaggcacacaatatacagacaatatactgagtggaatagctgtgtgattccaggattaaagccagaaatactggggcaacaatacgctgtccatggttctgaaaagggcgtgctggtttttgaaaaagcacatttattaatctggtaacgtctatttctctgcaggctgtgaaaacattatttttaaacattagaagggaccataactgaattatcctatgtgcatgtaagaatctgtaaacctgcagtgaactttttttggtaggtgcatccttgtcactaacacgctagtcagaaaatcaagtggaaactgatgaagcaactgttcccacatgtctccccacttggaattgaccacatctgttccttaacttgtgagcacagcacggatcaaaggactctgctgcagtagtcttgttttagtaaattaagtacctatcagtgccctgaagggttgctattctaagataccacacacgtgaatgcacacacatgctccagaacaaagaaacatcgttaaagcaacatctatagtgtctaaggagtgacccagaaatagtttagataactctctattacatcttctaatggcttaaaacagattcaacatttgtccatgaaggaactgcaatcgaggagataccaggtcagcatttctttggatcaaagaatccaacttgtttggaaactcttcagaattaactagatagaaatattacaggagatgccatctctgtccttgaagagccactggttacatttttacacaaaagcttagaggcattacctgcaagtgcttctgatgtgagttaatggagtttgtggaggagagaaaataggaaataatgaacagcaataaaatcagattttgaatgttttggctcttccagatgactaagccagtgaatggaaaaatgtagcttagctggttcattatgactttcaaaatctgtagataatgaccgtaaataagggggtgcacagtcaatcaaatagggatgtaatttagtgactaggaaaaatattaagcctactgggtaaaaacagctttgaaaatagtttcctctggttacaatttattttacttttaaaaatgcagcaggaaaagtgtggggaaagagaggttttgctaaatttagcaaaatacttgacatttttatggaaatgttttacaaatgcaagcaagataaaaatctagagaaactgggttgaggccagattcaatattcacgacccattttcataagacaagccaattgatatttttttctctctgattgaattggaaaaagagttctctctagctcactaaagagatacaagacttttttgtgtgaaaagaaacaatttctttccattttgatccatgaactcacttcctctaaccctttcttaacctccaggacaaaggattcctgccaaagagtctgaaagggaatgaggggaaacatgactaggagtgactaaagagtgaatgtccacttaagaattattaagattctgcatgtgttgtcaatatcagctggttgcattgttcctggcatagtgaggctctcttattaaaatacgagtatctgaatccatgtcagacggagggacaaaaggaacataatgaggtgtgtatttgtcagggtccacattactccaacaaaggttacaaaaattgaagcaacgagtgcaaaatcaaatccagagagtggcaagcattttaacagcttaaatggattatcaaaaatgaaaacagtaaatccatagcgctctgaatgtaaggcagtgtccaaaatcctgttagtcaatatttcactgaagagaacgaaacatgaaagtttcactggatgccaacattacatataaatgaagacagtggaagaataagacaatgggcttggagttggtgtccacaaattggtttcagtttacaatttgctttaagagataaagttatttttgtctctggaaaaatataagaaagttagttgactttaatataactgttttcccaggggggagatttctcaaacaactaaaagtagatctaccatttgatccagcaatttcactactgggtatctacccaaaggaaaagaagttattatatcaaaaagacacttgcacacatatgtttatcagagcacaactcacaattgcaaagatatggaatcaacctatgagcccatcaactgatgattgcataaagaaaatgtggtatatatacattgtggaatactactcagccataaaaaagaatgatgcaatgtcttttgcagcaacttggatgaaactggaggccatcattctaaatatatgatagtcatctagcaaataaatgactgttgttctttgtgagatggaggatgggtatgtagatgctgaataaaggtttatgggctgatttaaattaactgtggaccgacaggtttatttttaaaatgttttcaagactctaagcaatatagctattaatttacattccacagtgtcaagaccagtatctgaatatgtgatcttatttttttagcagctttttctaagtttgagataaatgaaagatgtgaactgggggatgggtttttcaagaatggaaaatctaatactacatattctcacttctaaatgaaagctaacctatgggtatgaaaaagcacacaagtggtataatggacactggagactcagaaagggagaggatgggagggagatgagtgatggaaaattacctacaatgtacactatttaggtgacaggtacactaaaggcccagacttcaccactatataattcgtccatataaccaaaaatcacttgtacccctgagctattgaaattttttaaaaattatacatatttttcccctctcagttttcctccagagattcacgtttgtcttaaccttccctaatttgggacaaacccacttatatgggagtgccaagggggaattagtgatctgaatttcatgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagactattcctattagcagaatattggcataaatcatcgtgcagtcatcattattttcactcttacatctagcaaataaatgactgctgttctttgtgggatggaggatggatatgtagatgctgaataaaggtctatgagctggtttaaattaactgtggacagctttatttttaaatgttttcaatattctaagcaatatatctattaatttacattctacagagtcaagaccagtatctgaatatgtgatcatatttttttcagcagctttttccaagtttaagacaaatgaaagatgtgaactggggatggaggggagtgaattaggatgtattagtctactctcacgctgctataaagaactgcccgaggatcacttgaggtcaggagtttgatatcagtctggccaacatggcgaaaccccatctctacacaaaaattagccaggcatggtggtgggcacctataatcccagctactggggaggctgaggtgggagaattgcttgaacccaggaggcagaggccgcagtaagccaagatcataacactgcactcaagcctgggcagcagagctagactccatctcaaaaaaataaactgtctgagattgggtaaatttataaaggaaagagatttaattgactcacagttccacatggctggggagtccccaggaaacttacaatcatggcagaagaggaagcagacacgtcttacatggcggcatgtgagagaagtgaagcgaagggggaagagccccttattaaaccccttataataataataatataatgagagccccttattaaaccgtcagatctcatgagaactcactcattatcacaagaacagaaggggagaaaccatccccatgatcccgtcacctcccatcaggtctctccctcaacagctggggattacaattcaagatgaaatttgggtggggacccaaagcctaaccctttcataggataattcaaatgcagcatcctctgaaatatgctgccatggccaaacagagctaaacaagttcctttctggtcccatcctctgagcaaacaagatttcctacaattccttataggaaagcaatagtcactatgaaattcacacacctagaaaagcagaaggtgagacggtgccattacttcttgaaaccatgacactgattcccgtttccacaaagggcacagagaagtccaccacttcagaacgttcctcattgatggtgagcgagccaactgccatgactgcccgttgatagaccacctggatgcaaggcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaaaaaccccaagaccacagaatgttagcactggaaggtttgttcacaatcattagctgtactcttctcctatttttcagatgagtaaactgaagtttaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatcttcatgacattttctgaattagttgatatttgtacacccattaaacaggtaaaaattaccaactcttaaatttttaagagtttataacatacacaactttagactagagtttagtcatcagatctaaactgagtcataaaaacttactagagaatggaagagaggaggatgtgaaattctcagagaaagcaaggttttgcttcattctataattacagaggcttgaaaccaaaggggagaagtgaaggtacccagacaacacctcagccaagaatcaggagacctgggttctattccatgcctgattttgtgcactgaacttctcttgatagagccaaatgttacatgagggctcattaataacatcttccctacctacctatgtgacatgtagtataaaaggagacacttctaaaagcaaggtccttgatcaggtaaagaccccattaaaatttaaactatcttaaaggctattgtatactctaccaaggctacacttactgttttgtaccagccaccttgctgtattcacctgaacaagacatattcaaaggacacccaggcaaaccagaaaaatacctttaaaaagaaaggaggccgggtatggtggctcacacctataatcccagcactttcggaggctgtggcgggtgaacacctgaggtcaggagttcaagaccagcttggccagcatggcgaaaccctgtctctactaaaaatacaaaaattagccaggcatggtggcaggcacctgtagttccagatactcaggaggctgaggcataagaatcacttgaacccaggaggcgggggctgcagtgagccaatatcatgccgttgtactcaagcctgggtgacaagagtgaaactctgtctccaaaaaaaaaagaaaaaagaaaagaaagaaaggaaacactggtctatccaacggatagcaaaaagtacttagacaattcacataagatcaaagcctttcttctgggcaatatgcttgattaatggacatcccattagctcaaccctgtctttgagttatgcatttcatgaatatgttctctgtttgaatatcccatttttggcaaatccacacattggagtgttacctaagcactaaagtgatgtctatggaaatccaacatcatcacaggaaaattcttatgcttccatgtcatatgaaaaaagtaggttacacagtagtacaaacagaataatcacagctatataaaaacagatgagcttatgaaataactgtatggaaaaacaatgaaatatgaagcataggacaggtgcagtggctcattcctgtaatctcagcactttgggaagccaagttgggtggatcccctgaggttgggagtttgagaccagcctggccaacatggagaaaccccatttttactaaaaatacaaaaatgagctgggcatggtggcatgcacctgtaatcccagctacacaggaggcataagaatagcttcaatctgggaggtagaggttgcagtgagccaagatcgcaccactgcactccagcctaggtgacagaatgtgactctgtcgagagaaagagagaaagaaagaaagagagagagagagagagaggaagaaagaaagaaagaaagaaagagagaaacagaaagagaaaaaggggggagagggagagatagaaagaaagaaagagagagagagaaagagagggagggagagagaagagagaaagaaagagaaagaaataaaggaggaaacgaggaaaggaagaaaggaaagaaagaaagaagcaagctattttggaacggtgaaaaacatgttttcttttttacatttttagggtttttccccaaattatctagtaagtacatactacttatgtaattggcaacacagacacacacacacgcatcaaacaacattgatttacatgatatacatcatctctatatccatgaaggtgggcagatttgacagaacaattttttaagagacacgctcttgctctgttgcccaggctgggttgcagtgatgtgatcatggctcatggcagactggacctcctggcctcaagtgatactcccactttggcctttcaaagtgctgggattacaggtgtgcgacaccatactcaagctggaaaacataattttgagtaacagaagtgggttgtaaatgacacctgcttatcaatgctttcctttatctcaggatcacagactgcctgtcttgaatcactctcttcaccattgtatcccacccccacatcctgtcagtgacttgtactcaaccactctgcttctgtcaacccagaccaccatagagactttactctcttgcctagaggctggatgacctgctgtcatccaccacccttagtgggggggtagtaggaggccacatctgtgtatatttacatgtgatgattagtgacctcaacactgtacagtcatgggatatgtgccagctccatctccaccaattacccagaatggagggggttgggctagagttaaaactgccacaaatatgatagaaatgtgtcctaagtacattaaagttgatggaatgtccagataccatttccttcttagtatacatggctctgaaaaatgtgtcaaaatcgaattctctttttctttctggtcgctgttggccatgcactgatgccctttccctacctctgttcatttgtatcaccttcattctatgttccttcccttcttcccctatcacaggctcttccttcacctggtcaagatttctggaagattagagagaagttttaggtgccccaggtttaagattcaaggtcacaggcatatagtggcattctttggtctccctggaaacctcagccagtttatgagttatctcacccatatccctgaacatgaggtatatttctaaatacaaatgatcaatgacgcattttcacccaacaagcacccactaagtgcctactgtgcacaagacatggaactgggccttggggacacaggatgaaaaaggcacgcagcaaaggcaatagttgaatttatcacagtaattatggaattgcagaccagcttgtaattgggaacgtctgttggttcctattacagcccttgtgtgggtgtgcaggggatgtgacttaactacacagactgagaaatggtccccatgtgatctctcttagtgctccaccaccacccaagagagggaatgactcacaaaaacaaatacggggaaagggatccaacaaattgtccagtttaccagctctacaatttcccagtatagccggtggatgtgagcacagccatgcgagtcagagctgtgtccaggtcctgggttggctcctgtccaccacgcagactcagacaaatctcatccagcacttaaaaataaatttcctttcttcccaccaatgatttgacagtttgggagcttaattgacagcatggccatttctcgctacacatcaggccaaatgatttttccaattttctctgcatgtctttatcacccaactaacagaccagaaaggaagatttctcagctcatttccggttacctggtattcttagaagatcccaccacttgccagaagtgagaaacaaaaaggtttcacacaatcatgttgtctaacaggaattctttttgcaactgatcagccttcctcaaagacgttccctataggaaatgcaattgatctaatcttctttaatgttgggattagtggatcctagcaattctctattgctctcacgagtcagactttcatttcatccagacacagtaaactcctcatatccccaagcggaagaaggaaagctgcaagctactatctcctcacagaaaccaaaaacgtgaatttgaacctgttaagctgttgatagtcttcagtagaaaagtcaattcttttaaagacagcaatttattttgatttctcttcctcatacaaatgtgactcagtacttggggatctacttgttttcagctccagggcttttgattttaaagactctaaactcctattattgattctggagcacacggggcctcagttgattgccctattgaaacacagagggtattgttatcataggggaggtgtcccactgaagttagactctgctttgtgccagccactttgctttcttcatcgggccaagttctgctcaaagaacacccacccaaattagaacatcctctgacaactttcccacatcatcccctccatcctccttgtaactcatcactctctagcactgcactgggtttcattccgtttcccaaactcccaagctcctttcctccccagggcctttgcacctgccattgcctctacctggaaggctttgcccagatattcacatgtctggcttcttctcatcctgtatatatcaccttaaatcttatctgtgtgagctaaagtaaccccacataccccgatgtactctcttctcacaccactctctttctgttcatcacaaggtttattacaacatggggtcacccatttcttcctggtcgaattgttttctaaccacgtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcctgaccccaaaacatggtctgtttcacacaattatgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaaccaaaacaggccttcacaatacatttagcaatcacatattatatctttaaaatcctgatctcaaggactgagatctgggcacttgcatcttgtgtgataatagctgagactggagtttgaaacgaggaagtaaaaatctctcttcctagtcatgaaacaaacattggtgtgtcatgctgtgcccttgtaactgagggtgcaaatattaataagtcacattccctatatgtaggtggctcagaagccagggagaagacaaactatacactgtaaagacaggtgatgagggtagagagagatacacccaggtactgtggaagtaggaagagctaacccagcttggggacgcaggagctacacttaaaggatgagtaagaattaggtaaaagaaacagatcagaaaagactcagaaaacaaataaagtttccaacagcaggcctttttcttctgtgagtctcctgtgaggtggtgtttttgcttatgtttgcattaggaaataccaggatcagggccttggaggtggccatggaggtttctgtgtccccagagggtttgtagattaaggggacctcataatggacaatgccagctctttcttcaatcataacaaaaggagaaatgacacagatgcagtgcctgctggctgttgctgagctgagaaactgccagaagttccatttgcacctggattgtatcagaaagtaacatgcaaggtgtgtgttcactcccaaatggagagacgtttttaaccttcttgagaagcatagatctgggatctataaaagagatggaagaagaatgtgtggggggaaggaaagggacagccagaaaagtggaaactaaataattatttttaaaaagactaaaggaagccggacacagtggctcacatctataatcccagtgactcaggaggccaaggcatgaggatcacttaaggccaggagcttgagaccaggctgagtaacatagcaagactcttgtctctaaaaaaaaaaattaattaaaacatgagccagacatggtggcacaggcctgtagtctcagctattcaggaggttgaggtgagaagaacacttgagcctaggagttcaagaatgcagtgagccgtgatcacaccactgcactccagcctgggggacagagcaagaccctgtcattatataaaaaaaattaatgttttatatatttttaacacataaaaatatataatgttttatatatttttaacacataaaaatatatgttttatatatttttaacacataaaaatatatgttttatattttttaacaaaaatatgtaatgttttatatatttttaacacataaaaatatataatgttttatacatttttaacatataaaaacatacgttttatacatttctaacataacagtaggggcatatttatttattccatgatgtattcaggatttcaacttcaaagaggctgacatttgtgacctcattgataaaattttctccaaaccaaaacaggccttatttttatatgttttatatatatataaaaatatatatgttatatatgtttaacatgaaaatatatggtttatatatttttaatatataaaaatatattggtttctatatgttaatatatgaaaatgttttatatattttaacatataaatatatattttatatataaacttgtacattaactatatattttatctataaacatatagtttatatataaaaatagtttatatataaaatatgtaaaaatatatgttttatatatctcaatatataaaaatgtataatgtttatatatttctattttcatttatttatttatttttgagtcagagtctcactctgttgcctaggctggagtgtagtggctcgatctcgacttattgcaacctccacctcccagattcaagtgattctcatgcttcagcctcctgagtagctgggatcacaggcgcccaccaccatagctggctaatttttgtacttttaagaaagacagggtttagccatgttgcctaggctggtcttcaactcctgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttataatattttaaatatataaaatacactgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataatttctatatatttatatataatgttttatattttaatatattaagatatgttttatatttattttaatatacaaaaatgttttctatattaaaaatataaagatattttttgaatatgtatgttcaaaaataaataaatgaataaattaaattaaactagaaagactgaaggggaggattgattcaacctaagggttaaaaacatgtctgtggagtcagttggaccactgtttgagtcctacctcttccatttcctagctagatggctttgaacatgtttcataatcttcccataactcggttttatcatatttacaatgggcaaaactactcacctcatattgctggtggaattaaatgaatgcaagtgtggcacatctctaggaatttatctaagtcttttttaaattgattattgtattatacctactataacgacgtgtattttctatgacattttgtgattcaagtacacatattgttactatcgatgatccatgctatttcaaagggttgggcacgttcaggtgacagcattcctgccactcacttgattttgacgaacttccgacatggcacggtgttcctcacacacgtctcggtcagggggtctatgtcttccacgatgacgaatggggcctcctccagggtgacgatgctgagatggttgtcatccggctcacagtcggagaaggacttgtacctgggccacacggcgtgcctcaggctcagcgtatggttctcccacttgcccacctgcagcacaaacacaaagacacagctgtgctttcttccgccgctgatttctggagaggcaaatcctttccctgccagagacatccatccgtctcaagggcctttctgccacatatctcaacatatgcatctacttctgtgctaagacaaacgggcataaagagaaaacagaatatagggcagttctccatcccagccgccctcatccccagaggaatcaacctgcatctctggaggcagtgcccaggcactgatacctttacagccccgcaggtggttctaatgttctgccagagttcaggaccacggatggcaaggaaacagcatagacttttagaatcagagaggtctgggtttgattctcccactgtaccacttactagctgtactaggcaagctcttaatcctaagatcttctgttttctcatctgtataatgaacacaattccccctacttcctaaggatgccatgggaattcaataaagcaatgcatgaaaggcaaaagcacaacataggtactccatattgtttctaagtataaaggagagaaagtgaaaaggagaaagaagaaaaaggtgctaagatgaaggaaaagagaaaaagggagaggaagatgaagctagagagtgaaaagaagaggagtgggggttgagacaacacagagaagagatggagcaggtggggaaattaaaagcatcattttgaccccagatacagttctatttaagttgcaaattaaggtgaacttttattaatcctgcacagaggggagactgtcactgcttagcgtacatcaagacctgtcaaaatagaatcgattgtattccctcggagcagcagtcggcatcttagtgcaatcaaattgaaggctgtatattttgaaccttaattttatttgacagcttattggcgctattcacatacacgctgggaggaagctgcccccgcaccgctctttctcccttctcctcctgctcccacacgccattgcttgacaccacaggtcaccgctttatttgtaataccaacctcgaggaaaacacctcgtgtgaaaagctaagtgccaaatccaggcttgtctgtgttgaccagacccactcacctctcctcctgtaatgtttaagtgtcaccagaaatgaatctcaaacccttaaagagaattcaaacatgccggacaccaggagaggtgacagggtgggaggagagaaaagaatcagtgctctctaagattacctcatcatatgggctggaaaatttttgctggctataaagaaacatttcctgtggctaattacaaaattgtccagcattgctgatacatttctttttaagataggatggcgagtagagcaatttggttaaacacacacacacatgttcatttattcacgctatgatatgtaacaggctggggagaatgctgagcgcatcaaattcttcattcattcgacatagatttattgaagacctacgatgtcccagtgccagcctaggaataatgatggctaaaacagaatgactcttgccttcttggaactgtcagtcagttgtacgacatagatcaaaccaaaaatactgaaatatgcaaatagataaagaaatatacaagtgtttccttttggaacatgttataccaatcccttttctttccatttgccttggaagactcaaacacaaccttcgagagagggtgggtagttcagtgggtaagagaatggcttttgaagtcaaacagaactaagtgtaaatcctggcttcatccactagctgagtagccttgggaaagtcattcaacctctctgagcttcactttctccatttgtaaaatgaagagagcaacagggtatgaccttgaagactgcagtaaggtttgaatgagccaaaaagtaccaaaaatatagagcacaaaacctgacatggcatgtaacacatatggtggctgctattattttactattgttgttaacatttaaaacataactgaactgtcaccttacctgtaaaatcattcctgctttccctagtaatatagaactttgcgcatatctccaccgtagcattttatattataacctcaatgacataacttttgagcactcctgtacagtcaggaaatgtgccaatatcaccacttagtttaattcctacaaactctacatggtaagcattattattccaacttcgtagttcaggaaactgaaacacagagaggttatgtgacttgcacaaactcacacagcaataagtggtggaaccagagttataacgtggggctttctgaacccaaaggtgctttctcgctatgtacagtgtttctgtgaattgagctacagtaaccacgttatagctccaacactcttccttccttgcagacatgtttcctaaagtcccaagataatgtaaattaaggcaaagactagcagaatctttggtgatgtcattgaccacatcacaacccccacaccatgggagtcaggcaaaagtttcagtccaacgctcgctcatggagagaaaagttgcaaaggtttatgagcccccagagtgcaataacttcctaaatcttctccaagttctactccctgttcctgacacatccaagtatccatgggtcagccaaggaggttgaagatgagtggtaggtagagagaactcgatcaggagctgaagctgctgtgtcaacactgccctaggtcccaagagctcttaccttcttttctcatctgatagacccttcggcaccccactgcaaacaccaaaaatctcaactactaaatcgtatataccagataaaggagaacagacattcttcactttccctgcctatattcctatttacaagggactataactgaggccagtgtttgtagacaggtttagcagagtcattcattccataaatatgtgttgagtggttactaggttccaagcactgtgctagacactgagaatactgtaatggaagtgataaaatgtttgcttgcatgaaatttttgtgctaattgagaagacacatgagtcaaatgattacacaaaaacatatgttcatacaaattgggaggaagaaatgaaacatgggtctaagagagcatataggagaaaagatatcagagacatcttccctgaggaggtgacacttaagctgaaattggaaattcaggatgagttgcatcgtggcagttgtgggaaggaattgtggaggagcagagaaggaaagagcactccagataggtggagaccagaaaatgcaaagccttgtaggctctattaagaagttgggatttaccttaagggtttgctacagactgaatatttgcgtccctccaaaattcataggttgaaatcctaacccctaatgtggtggtgttaggaggaggggtctttgggagctgattaggtcatgaaggtggagccctcatgaatggggttagtgcttttatgaaagaggccccagagagacccattgccttttccaccatatcagtatgcaacaagaagattgctgtctatgaaccaggaagcagctctcaccagacgctaaatctgctggcaccttgatttggacttcccagtctccagaagcatgagaaacaagtttctgtggtttataagccacccagtctatggtattctgttacagcaacccaaatggactaagagtcaatcaagttcaatggccagaatggaaaaagatttatagaagtcaccatggatatatgtccatatataacctgcctgaagatggaagcttctttgcctactccaatttttttttaattatggaaatgttcaaatgtatttaagagtagaatcatataatgaacctccgtattcccaatgtccagcttcaataattagtactcatgaccaatcttgtttcatttatactcccactcactccttctatattacagcaaaaaaacccattatataatttattcataaatccttaatttgatttaaatatctaaacatcatttgcttcacaatattatacctcaataatctacaataatctatgtgtttatgtatatgttttacttatgagactatgatttcccagtctaccaggaattttatatgcgtaatgattggtttctatgtccacagcttctaactcagggcatgccacatggagggacttaatgggtagtttttggtggagtgaataaacatacagcctgtattttttacatgtgcatgagtcagaaagtgttagaatgattaatgtgtccatatgtgcctcagctttggaatcttgtaccctaggcaaaatatggaagtatcaaggacctgtattctctcccttgctcttactgcaacttcagcccccgagactcagagccattgagggtggccgtctgaatagcctttgggtattaaatttccccagagaaagcaaacagcatcatcctaacaccattttaaaaagggactccagccaccagagtattcagggagaaagaaagaaccaatgggttgaatcctgaagacctcagtttcgactgtcatattgtttctgcttgtctccatttccacagtggcatggagtatgtatgctccaaatgcctttatttagaagttatatccaaaatggaaggaccctgtgcactttgaagatggcagccaaaaatatctctgctcccaccttggacgtgatggtgactcttctgctattctctaaactggacctttttcctgttcccaatcctctccataaaagtgaacaccacactcagctgagtctgtaactttagatcagcattcctgactcataaaagctattctgaagtgtgagccaataccagggttgcaccgcatttcctccagcagtgcttccaggagtaaggtttcaatccatttcctccagcagtgcttccaggaataaggtttcaatgcatcagagcaagtgaaatcatacagtccttgtcaatcacatgctatttttggagcttggagggaaaatgaagttccaggacaccttgccaaacttctggttatatttatacacaaccaggacaggcaagcacgcttgtgtgtgtgtgtgtgtgtgtgtgtgtgtgtgtgctgtatacatgtacatgtatatgcacatatggatcccattgagttttcaggcatcaacttcattgctacagaacccctctcttctctcctttacatggcacaggacaagagggttcagaatcattaatagcacaggcttagagatcagacagatgaacaggttcaaatcttgtcactgctttagccatgtgaccttgaacaagccacataatctttttgaacctcagttcactcaatcaccaaataaaaacaacacttccatttcatatgctgttatgaggcttacttataagataataacaacaaacatctcttaatgcacagttcctggcacacagaaaggtctccatacgtggaactattatcattaattcaacatttgttaaacttatcttcaggaaaatgagcctctgtagcagaagaactaattgacaaatggagatctgagtttcttcaatggcattcccttgacttttgacctcactgattgggtgtcattctcctcactgtaacaggaatgaggggagtgggtttgaatcagataatctctaaggtctttcaggtatagcactctatgtaaaatgcaaggataagctgccctcccaaatctttcctgatttgagctcagggtaatgagtacataattagaagaggggcaaaggtggcactccttacttgacatttaattctgtatggcaaccatatattagggcagtcttgcacccagggtgaaaggacagcagaaaacagccaaatggcaagctatctctaaaaaaggtggcaggatggttctgagaaccagttagaagactgaggaaagaagaacatggtcaatagagccctcttggatagtaattctccatgctgcacaaaaaacagtggtactcaaatctgaggcttttctcaaagctggctcttcctcattctctaaagaagggcatgagttcaaatcctgacttgtccattcctagctggggcacagtgggcaataatgacaaagaccattgttaacactgattagggctttactatgtgtttccaggagcagtgctaagggtttttcattcattatatgactcaatcctcaaggcaactgtaggacatagataactataattatcctcattgcatgatgaggaaaccagggcttaaaaatattatgtttcttgctcaggtcagatcataaggctcacagtaagaatttaaacttagtcagtgaaaacctctagagcacagcttaatcactacctccctttttgaaatttagtttcttcatattttaaaggttacaacaaggccacagagttgttataaagattacataagattcacgcctgtaatcccagcactttgggaggctgaggcgggtagatcacgaggtcaggagatcgagaccatcctggctaacatggtgaaaccccgtctctactaaaaaaaaaatacaaaaaatttgccgggcatggtggtaggctcctgtagtcccagctacttgggaggctgaggcaggagaatggcatgaacccgggaggccgagcttgcagtgagccgagatcgcgccactgcactccagcctgggtgacagagtgagactccatctcaaaaaaaaaaaaaaaaaaagattacatgagatgataaaaataagtctttccgtttctactattccgaaagctttaataatttctgtaatcctaaaaatagatacatgaataacatgctacttttattatctccatttcatagatgaggaaactgaggcatggggtttaagtaattgtccaattcatatggcagaaccaggatgtgaacccaggactcatttttaagtctgtgaaaaaatgcaactagaattttctgctgaacaaaaaaaaaagactaactttacaatgcagaaatgtgacagatgtgatgtcagctcaatggtcaaagccaatatggacaatgataaatcattctaatagtacatatccttaatatgatgtgatgataatggcgtggtgttctacctgtgtcgtcttataacctcggtgtaattataagaaaactatcagaaaaattccaatgtaggggtattctagaagatatctgaccagtagtcctccaaattgtcaaaggtcattaaaaaacaagaaggtctaagaaagtgtcctagtcaagaggagcctaaggcaatattacaattacatgtcatataggatcctggatcagctatcaggatggaacagaaaaagattagataaaaactaaggaaatctgaaaaaatcatgggttttagttgacaataatatacgaattgactcattatgacaaatataccatactaatgtcaggtgttaataatcagagaaactgggcattaggtatgtgagaagtcactggactatctttgcaagttttttgtaaatataaaactagttaacctaaaaagtttattcaaaaactgtttttgaattcaaaagggagagttttttaaaaacagcaaatatgttctcagacacagagtagcaaagttgccaggagtttaaactttggagccagccactctggcttcaaatcccagctgtaccacttgtgagctgtgccacttgggcaaatttcttaatatctatttgcctcagtttcatcacctgaaaagtaggatgatgttaatagtataattcacaggattgctgagaggactaaattaatgtattaaagcccataaaggaatgcccaatgctatgtgctatgtattgctattttgtcattgtttaaatcaatggggaaacaattttagagtagaatttagattatttcatgttttaacttcataagagcttttctcgatactaactttagtttaatttagacacagtttttaccatgtcagtagttttagccataaatcacgcttttctccacatttctcccaagggtttcacaatagccttatgctgttttgcttacctgtcattcatttatcagatttttggttatagcatattcattttcccttggagagatgctgccctaatttaacgaataggcacgtgtcctttatttggcaaatcagtacactgactggctcaggaatgtgcatgtgacctaagctaagccaatgagagttttccctgggacttttgatggaactatcagaacagggcagtcatgagagaacaacttatcagaaaataaatactggctaagaaattgagagaagaaagcaataaagtggggatggcattgcttgagttcttataataacagtaaaaattgacattcactaggcacttattatgtatcaggcaccattcttagtgctattttaattctaataaactccctatacggaagaggaagttagggaaatacttttttatctctattatgaatttttttggtacttaaaagcagttctcaattcaacaaaataggttgtgtgggaggagaaaaaaaatctttacctttaaaataaactgaattttggtgataagcctttgagtgttttcagaaatatactgaagttgtgacgacaaaaataataataataataattgaccgctgatggagaaaagtgattttgctaaaagaaatataaaaagggtagattaactttgtaatgatgtttaattcctattaataaaatttaaatacagtgcttttaggaaactaattgctcttcagctcctagaaagattttttttaaagggcagtgattacttatcaaaatgttcagccaatatgttcttagagcagagataatttcatctccagaaattgtatgtctcaagttaatatacacctcttatgtccggataaattcagagggatgttgccaaggctgcaaaaggctggaagaaattaggttaatagatgtgcgtggctctttcaaagagatctgagtgttttatcttatttgatctatttatgaaatgcttacaagagacaattaaaataacctcatcacaggtctcctggtctctgaagccacctcctaaaaaacaaatatctaaacaccaaaattatagatctactccatgctcaagtccctccatgtctcatgctgcctacaaaatcaaatccagactgctctgtatagtaaaagctcttctataatacaggcccaatcaacctcactattctctttttctcactttctctctctcattctcacacacatcgtcacactaacacacacacacatctgcctttgcacacacacttatacctacacatattcacaattaaacatggaaaaattcataatagagataaaaagtatttcccaaacttcctcttgtgtataggaagtttattacaattaaaatagcactaaaaaccgtgcatacataagtgtctgatacataagtgtccagtgaatgtcagtttttactattataagaactcaagcaataccatcagtacacctacacatatatgtatacatattcctatacatctatacatgaacctctacataaaagcacacttatatacaggtacattcatgcctacccacgctcacattataatcacatacgctcacacccacacgtacaactacaaatacacacatacctaacacaaacacatatactcgaacctctacacacacacacacacacacacacacacacacacagagaggatatgaagctacaatgatgcatacacttttcacaaaacacaccctgaacgacacccactttcctgcctatgcctacactatttcttctgcctggaattcttctccttattatctccccctactgaaatcctacccactcttttcaggcctagctcaaatgccaatactcccatggaacctaattctccatctggaattcatttttgcattttctttgcctttagaacacactttcccctcacttgtttattcatgagcccacatgccttcagtgctttccactgtgccgggtaatactggaagccctggggctacggtggtgaacagtcctcagagaggtctatcctatccctagagtttccagtctcggtggagagaagtcaaagcttaatagcaatgaagtgaatgaagtgagacaaatgctatgccgggagcaggcacaggatgctgttgaagaacacagcttcctaatctggaagagaatccaaaaaatgcttctaacaggaagtggcttccaaatatgaaacaggcatggtggctcgcgcctgtaatcccagcacttcgggaagctgaggtgggcagatccctcgagatcaggagttccagatcagcctggccaacatggtgaaaccccatctgtactaaaaatacaaaaattagccaggcatgggtctgtaatcccagctactcgggaagttgaggcatgagaatcacttgaacccaggaggcggaggttgcagtgagctgagattgcaccactgcactccagcctgggtgacagagcaagagtctctcaaaaaaaaaaaaaaaaaaaaaaaaagaaagaccaagggagttagtaggttgcctgttatggggttttatctttatcctatgggcaagtgacatatgtaagggatggggatgaggacttactgaagaccttactgaaatcaatcccccaattagaagtggattaaacacttcttctcaatgtagtgcagagatagagtttgtagctagaagattcggaaggcagagtgacaagctgggagatggctgcaggatctggatgacacaggccatgatggtcaggctggtgtgaactcaaagtgtaaaatcaacagaaaagagatgggctgtaggggtggggaatgagggcccagtttgcctcgaattatggttttgtagagtgtcatggctggccagtcttcctcaaccacgtgatccatgttcgatatagtatagtgctcacccacaatgcagttcaagaagtatccgctgaactgaattcaattctgactgtagcatatcatccatttttacttacaattcagagtttaaaaagggaagttgcctgtttactcatcttctctccttggagacaagacaatagaaattgcaaaactaaaaatcagacaggaaatttattaaaaccaacaacagaagcagagttcaggctgcctgtgctctagtctggctggacccagttagctcattgggtggtttcataaccatggggaaacaggctttaaaacaaacacattgagcttgcaaaccttcggagtatgtttcactccagaaaataagcagtgatttactcccaagctggagaaaacatgagtaattaactcttcaggaagatgatgttaaggaggaaaaacaaagcaaacgggagaccaatttctctccacctgaaatataaagtctgccaaaggacatgagataaatggccgtgaaggaaatttaaaatgatttagtgtccatatttatcataagtagcaacatggattagcatcacttccatgccgctgaatgcacatctgacacacaaacaaaccgatcacaggttaacacataagtaattctgggtcttgggttgctgcttgaaaccaaaagcagatctaaatgtaattgatccagaaacaacaataaagatatctgagccactgctgtggcttgatattaggttgacatatgctgtatctggaggactttgcagttgagttcagtgatgttttttaaaccaatacctgatctaaagagtatcccagaaaaccagtctgctgaaatcaagcgtcactttggaactcaattttcccctgtgtggtatgcacaaacaagtttctatgcagaaattactaaagagcaggtgtgggtcaaacctgctctgtcttcactgccatgagccttggatggctaccggcagagtgaaactaagaactgcttttcagatattgaggtaaagtgcctgcttcctctgaatgcactgttttaaatgcaacgattggaggtggtgggattatgaagctttggcatgaataagaacctttcctggaagctgattaagaatgcagactcctgtatctctggagtgttggaatcagtagatctgggataaggtgtgggatcctgacttttcaaccagcgtcctagagtcattctgctccgtgtggtctaaggaccccattttaaggagcaccaggaggggaagacctatgactaacatacaggattaaataaagcataagaacaagatggaaatctttcttcttgggttacttatgtaaccactggcaattgccagcagatctaaatgagtttaatcagctattagagccttaattaaattcctctcagttgaaatttcagaattgcctaattgttacacagctcacattggagaagtagattttttttcctctcgtaataactgctctcaagataatctagtatctttatggataacagcatcaactgtcttagaacccagtactgatctggtaattcatagaaacgtgttttgattgttatttccatgaacaacccgcatctctgcttccattctcctcttgaggctcagccaacaggggaagagctcaatgcttgttcaatctcaaatttaaaagcggaaaaatctttggaacaaagagccatcattttcttcaggagttcatgtataatcttcagtcctccagagttcctttgttgccagatccctggggaaagataggagtcctatttctttggattacttttaattctttgtgtgctcttaaaagtgatgggttcttgtaattagctaaaaagttaatagtgttttctctcttttggttctaccttggagtaatataatgccagagacttgaaaaatcagcaaaaataaaaaaggagctctttcataatcatggattaattttttgaacttgctcttgggagtccttcattgtgcaagttccgtatcagtccgtcttccatgggctgcaataataattattaaacaattaacgagtataattgttggcatttattgaggtactgtgatcaccccaacgggcattttctattttaccctcacaatcctctgataaaaacgccattattagactcgttttgtatgttggcaaacagggaatttaagtgacttgcccaagatcaaacagcaagtgagaagacctggaatctgagcttggacttcagggcaggagctgttaccactgcctgatatttccaaggctgccatcctatttgctttgggaaatattaaggcaaacatgagcagtttggtttcttaagggaatatttcatggatcagttgggaagacagtattaataattagcaccatgcagcacagtgatgtcctgagagttggagaagccaggttctcgccccaatatgcacagtcttccactttgggaaggggcaacattttctttccatgtggagcacaggaggtggggagaaagcagccagaggtggtcttacagtgtgcttttactcatgacagttttacttcttccatttgcctgtgaattgactcttctgaggaccttgaattccaccacagaaaatacctctaacagcagagctgcactgagctctactttgcaggcttgatgttgaattccactgctaccaacacggacatccaaaaggcgatcagaacagcagatcaggcagagaaaatcaactgttcaaatgtgaaccatgtgtcaattaggtaatttgggggtttcaaccaagaggaatgtcattaatgctctagcagctgattggacttctcccttgcctctgtggtcatctccatccattatgtaaggggccttagaaaggaggatttcatcttcattctgtatcatgttatatttgagatattgttggccaacacaacacaattctgtttctatatctgcatctgttattataaaaacccaaacataaacttggttgaacttaaggggctgcttcttggaggagaaaactagaatgcatataggtctgcaaaaaaagtttaggaggagatgtgaaggtaactaggacaatcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagttttttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaatgcatcaaacctgacttgaaggatctaacaagtcaaaagctgatggatttcctcactcagcattatgtaaaaagccaattccatttggatctcagccctgaacattcaaagttaacctcattgactgtgtctgcagagttttgcaataaggttacagaacctggaggtatcaatcagtggaacagcatttcatccccctcgcctgtgaaaagttattgcgttgtgagaggtgaaatgtctggaacttggtagcaggtctctgatgggcatttgttcttctgtatctggggcaaaataataaatttaagtttttgagatggacattttccttcttccaaatgaaaggggttggtgcctgaggccctgctagttattatgaggatgctaaccaaagccgttgtgcatgggtgaaatgcatcgttatgatgaaatgcacactgatgagaatttcaattttccttagataagatggtattttgacaatcatttttctttgctcatctctggcccaaaactactttgctccaggcttgtctgagctctaaagtattccaacaagaggatcatttgaaatactaaagccaacagaagatttaatagtgagaaaacagtaataagcttaacgacagctttgcccagttaaaaacgtgattattctaaggcactgggggaagaggagggttcccttgggatgggatggataagacttgctgtttttgaaaactaagcctaagtaacccaccaccgtcaatccaatttcacccaaaccaattatccccatctcagacagtaatcaacaatttgagagccctatggagccactgggagaaatgagaatcatggtgaccaatcaggaagcctctcagcattgcttttcccactgaattattaatatagtggcaaacacagcagtttaaaagaaccgtgcatttggagttggaagacccaagtccaagttcaactatgatacttatgagctatgtcacatcaaaacctttcaaactcacacaaattatagccaaaagcagaatctcaggattcctaattactccaagtgttacaaccaataaacagaactattctgtaggttttcagttccttagggttagatcacatgcattcatcttgctcattcattcatggagtgcctactatgtgccataaactgttctcacactggtaacacagcagtgaatagaccctaaacctggggtcagcataccacagcccaagggcaagctgtttctgcacagcccacaagctaagaatgggttttccttttccatttttaaatggttgaaaaaaatgaaaagaatatttggtgacacaattataaaattatataagatttgaatgtgagtgtccctaaataaagcttgattggaacacagccatgcttatttccttacatagcctcaacgcttgcctttgcactaaaaatgcagagttgagtgcttgccatagagagagtatggcccacaaagcctaaaatatttactagccagccctttacataaacagttaggggttttgtcaacccctgctctaagtccttatctgtaaaggatccactcaccagtgaggaagataaaatacaatgccctctgaattaatcatacaataaaacagaaaatgctaacagccaaagggtgaaaggtgcaagaaatgcagagggcttcagaagtgagaggcagatctgatgagggaaggaagaaatcatgaaggagtgcaatggaggggagttgtgcagtttgcaaaggacctgaaaagtcagagtggaaagaagggatgtgtaggatcagagaacagcatgcacaaaagcttagaagctgagttttaatgacatgtttgtgaactaggaagttgtccaaacaggaagaaacacaaatatataaaggagaagagagggaaagaggaataaagggataccatgggacaagactgaagaagcccttggatattgggctacaatccctttgtgcacattggaatttggttgcatttaagttgaaattggcaattggccttgggaaatccctctgactcaacacctggggataatattggtgatttcatccacatatggctaggacttagtactccttacatattttgaaattgtcctatttgcaagtaattgatgtcatttcataaacacatccatacttgtcagagcatttggataaaactgaaggccagtttttttgaccatctctccactgaccacctccagtccactgtagccacccattcctatgggtgaaattcacttagaactgcttgacttgagtgactctaaatttagaacctccagtccactgtagccacccattcccatgggggaaattcacttagaactgcttgactcaaatgactctgaattcagaaaatccacagctctcattcaggtattcttatgtctcctctccagcgtcatccctggtctctatcttctctcaattagtctatttgttcatgccttcatttcttcccgattccaacttagacctctttatccataacattaacagatttcttgtcatacccacaattttcctgcccccactttgtcttcctatcacacccacctggcagcaccctccccaactctgagtcaatcccaccacttccacacctgtaaagcagcaagtacaggtggagaatatcatataaccacatagattaatgtcatttcaaattttaggactccctctctggctaaaaatctttcctttttcctaattgcatctctcccattccctagaaactatttcaaaccttcacacctgcccacaagactgcaaagctgccagctccagccccactcccagctgatgaatctgcctcttatttcagactctatggacaacccacatcacccacaaactcacctgcctctgcacacatgtctttcttctcccctctttcagtaataaaggaggcatctctcctctagcctaacacgcatcccagcccttgggctctagatacattctcttctgcactgtccttgcctctcaaactgacctaagacctccagtggttttcactaaatccaacaggtgcactgcacataagcccctcctctgcatttgacaatgggactactcacatctttcttgagttctctgccctagactgtcaggacactaccattacccaactgtttcccacctcgttggctgattcatctctgccaaaatgcaagcttctccttctctgaacacatctgacttgtctttcctctccctcttgcccccagaacatccaggctcaggcctcggcctcttctgctccacagtctccagttatcacctctcttgacagcccctgatctgctgcctttcccccattcttctctactgcctccgagaaacctcaaactcagtaggcttagagaagaactcagcctcttatcttccaccgtaaaaaatagtttctctcccatctgccatataggagttcttgaaatcccaaccatggaaatatccattaattcatctctcttctgccacccccatatatattaaatcaatcaccaagccttgatagttctaatatttgaacattttttactgctttcctaactcacagccaccaccctcatccaggccttcacctctcactggtttatgactcagcttcttagctggccttcttgcttctggtagatttgctcttcatcccattctccaaacagcagcccaaaccatcactttattttttatttttttgagacagggtcttattctgtctcccacgctggatgcagtggcactatctcagttcactgcaacctccgcctcccgggttcgagcgattcttatgcctcagcctcccaagtagctgggattacaagtgcgcactaccacacctgggtaatttttgtatttttagtagagatggggttttgccatgttagccacactggcctcaaactcctgacctcaggtgatctgcctgcctcaacctcccaaagtggtgggattacaggcatgagccaccgtgcctagcccaaatcgtcactttaaatacctctgtgtatctggcccttccactccccagcttgtggccttttaatggttccccactgcagctggaatcaagtgaaaatgcctgaccatggtctaagtgacctggcctcctccccaggccttcccttccctctgcattcatgacagcctcattttgacaaccaactcctggttccagccctgccccacatcaactcatgaatcacacagaactaatcacaggcttctgagtacattgagcttttctctcagtgccaggtttcaacacgctactcaccctgcccagaaaaccccttcccactctctgcctggcactctcctatgtgtccttcagaactcaacacagagggcagctgttctgggaagcagcctctaatcccataaaactgggcaggtagcctctcctttccctacctcactagctagtgtgagacctgcacactcatctgtctgccccagtggactcattgagggtgggactgtgttctgtttgcctttatggccctcgtacccagcccagggctgcttacataatagatgcacaaatacctatgaaatgaacaagttagccaggagcggtggctcacatctgcaatctcagcactttgaaggcaaggcaggaggatcacttgaggccaggagtttgagaccagcccgggcaacatggcaaaactctgtctctactaaaaatacaaaaattagctgagtgtggtggtacatgcctgtaatctcagctactcgggaggctgaggcatgagaatcactttaacccgagaggaagaggttgcaatgagcctaaatcacaccaatgcactccagcctgggcaacagagcaagactctgtctctaaataaataaaacagacaagttagcacacagaggtaccaacatgaccaccataactatgatcttcctgcagtcaattatcaactataattatctcttctggtaataggccctgaaaatgatgtggattttggagtcagccacatctggacctgaattcccagctcttctgcttaccagctatatgaacttgactaactttacttcttggacatcagtttccttatatgtaatgtgggcataataggagtaatcacatcatattattctcatggaaataaataaagtagtaactgcaaggcacttattgaactatctgccacatagtccctgctcaaccaggattaggtgttttattatatacagggatcttagaaggatgacattaactcatgtttgtgaaccagcagtcagatgtctggcccacagaaggtatttagtcaaggttccttcccacctgcaatgtgcatgttcttgtaagctgaatggaggacactggcacaactccagaacaggcaggaacaaggcattgtttttaccaaaattccaggcctagggcttgtatgccaaaatgaaactaaggaaatgtatttggattttttttccctgctctaagaggagacagatctgcttttcacttacggctctctattttggatagaaaaaatatcatctgttaatataattctgtgcacggagaaggcggtcctgccaaaagccacttggtgttattttcactctaccaataaatccaaaggcctggcaattatttttaattccatttgctagtttgaggttctgcacgattaatgcatgccattaatttcataactataaatgtaacccaagctttcttggatccttgtgtcaaacagtgtgaccttatgcatacacttgctagtgttcacttggctaagaagctgtattggggaaaaaatgaaaagaaatagaaaaaaaaagatagaaatttcagataatagacacactggaagacacatcctagccagaaagctgcgtgtcattatgtggataataatacaaaagtcctagagttaatatagctctttatgggctagaagttgctggttattttctcatttcacttgaccatcacagcagagtcacatagatgtgaaagagatattattacaatttttcagagcggtaaactgatgttccttcaagtaactttttttcttttttttttttttttctttttttgtagagatggagtctcgctctgttgcccaaggtggagtgcagtggcatgatcttggctcaccgcaacctccgcttcccaggttcaagcaattctcctgcctcagcctcctgagtagctgaaactacaggcacacactgccatgcctggctaattttttgtattttagtagagacagggtttcactgtgttgcccaggttggtctcgaactcctgagctcaggcaattcaccctcctcggcctccctaagtgctaggattataggcatgagccaccacgcctggctcaagtaactttcaaatttaaggactattctcatgtctcttttccaatgtcattttggcctctgggctctggacccctctattttctcccaatcaatctgctcattcgtgactttccattttttccctattacagcccagatctctttatcacagcaacagatttcctgccacgcccacaattttcctgctcccatcttgtcctcctgtcacacccacctggcaccaccttccacccagctctgagtcaatccaccacttcctcacctgtcaaccaccaagcctcattcacaaattacagcaaatatgtgaaagaaccagaaacagttttctggctcctggatgaggacttgcttaactgtatgtattgcaatatattcatacatatgcaggacttaaaggactccttgaagacacttgtctctaaaactttggacccaggtcctttgataaaagagaacactgtcaatagacttttagaaatccactgaaaatgaaaaaaaaaaaaaaaggtaaaacaaccctaaaagtgccatttaaaagtctagaagtctagagtctagattgcactttgtatatgcataatagttcctgtttattaagatctttctaactacgttccaggcctcatgctagatacttggcatgtatatcatttatgatgcctctgagctatgaagtggctgggtgaccatgttccaatcaattcacttctctggtcctcatttttctcatctataaaataatatgtaccatttggggttgtagtgaacataaaatgtggtaatgtacataaagtggttggctcaggacctgtgatggaatcacagtttaaaaactattaggcactttttttttggaatgatgcaaggaaaactaagctccattcgcttcccacttaaattctctatctcccacagcatggcacaattgcacttgctttgtagaatttgattgaagaaagtagcagaagttagtagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgggagtctcacaaatgttacccctggccaaactcaacagcgtaaatgttgatcaaactcgctctctaaccccaaacagctcagctcctaaccggtgccatgctcagtgaaacaggggaggaagtcgccagcccacttttcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttgaatcctcatccattttcagtgagatgacaatgcctcaatgcaaagcctccatgtcattttggtaatgaaactcaaatcttcgggtaaagaaaatgtggtatatatacacaatgaaatactatttagccataaaaaagaatccaatcacgtcttttgcagcaacatggatggaactggaggccatgatcataagtgaagcaactcagacacagagagacaaatactaggacagatgtggtggctcacgcttttaatcccagcacttagagaggccaagtggaggggtgggggaatcacctgagctcaggagtttgagactagcctgagtaacatggcgaaaccctatctctacaaaaacaaaacaaaataaaaacaaaaaaactagccaggcatggtggcacttgcctatagttccagctacttgtggggctgaggtgggaagatcacttgagcccaagagttcgaggctgcaatgagccatgattgcaccactattctccagcctgggcaacaaagcaagaccctgtgtcaggtgttagaaaaaagaaagaatgaaagaaaaagaaataaggacaaatactgcatgttctcacttgtaagtgggagctaaataatgcatacagttagatgcagaatgtgtaatgatagacaatggagactcagaaaggcaagtgggtgtgagggaggaggctgagggaagaggctgaagagaagctacttaatggatacaatgtatgttatttgtgagagggatactcaaaaagccctgacatcaccactatacaatctatgcatgtaacaaaattacacttgtataccccatacatttaaacaaacaaaaaaagaaacccaaatcttgctgtattgattcaagtcaccaacctgaatgccaaaagtggaatgagactgggtgcagtggctcatgcctgtaatcccagcactttgggaggctgaggcaggagaatcccttgagctcaggagtttgagaccagcctgagaaacaaagtgagacaccccccatctctaaaaaacaacaacaacaacaacaacaaacaaacaaacagaaaagaaacatctgtggaatctttcctggtcttagagaaaacaaaacaaaaaagtggagtgaaatgtttactattcttgcagaagaaggctgaacaagtctcgtctctaaatcttagtctcttcacctattaaaagcaggtaaatgtttctgctttccctgtatacagcatggatgtcaggatctgatacccaaaactaattgttgccctgctttcctatgttagatctgcctgtcctagtttcttcaaacacactttaattgtggaaagaaaacatatgccatcagctataatctgctggaccacatagaggccagcacggtaggaatcaacaggaattaggattcttccgattcaaattgtttgtttcaatgttaaagttaaagacaacgtaagtgagaggccattggtttctatgagtcattctacaactccctttaagggaatacgagttgattctcttgtttttccccaactttagatttttttctcatgggcatttccaacggagtctttcttcacatccagggaagtcaagatggctcagcctctactcttcccatctcaaacaggcccactcagtctttctaatttgcagaattataatttaaatggaaggaatatagactccaggaatatgatttcgatgagttttaaagcacgttttcaaaagacaatggctagataacaaaccatacggtggagtaataaggaataaaggaacagtttactgcaggggtggggactgatttacagcttcagatgtgcagaggaatgctgattcgttttgcacaaaaatgcaagagactgattaggaggcagatttgcatacatctcagtgggatgctctgagccgagctcagaaacagacatgtggttcagcagggaatcttgtacctgtaatagtccttcttgccaacgctgggggcacatccactgtgcagggatggggggacccccaacatgagtttttataattaaagcactgacagccttcactactgatatatgaacgccacccatctctaccataaggtactgtagaaacaaaatggactttgcagtctagcagacctgagctagaatctagactttgccatatacttgctttgtaaccttaggcaaatcagcaatcatcttagagcctcagtttcttcatatgtaactggagggagggggcaggagtgatcatactcatcttgaatgtctgttaaaagaggatcaaggctgggcacggtagctcatgcctgtaatcccagcacttcaggaggccaaggcaggcagattgcctgggctcaggaatttgagaccagcctgggcaatctagcaaaaccctgtctctacaaaacatacaaaaaaattaggcaggtgtggtggcacacacctgtagtcccagctacttgaggggcagaggctggataattgctcaagcccaggaggtagaggcctgcagtgagccactccagggagtgcagcggcatgaacatggctcgctgtggccttgacctatgggctcaagcaattatcttgcctcagtccccacaagtagctgggactacaggtggctcctcactgcagcctctcgtctcttaaaaaagggtgtgtgggggaatcaaagtggtgaatctatagcccctaggccataatcatcatcatattttttttataacatatgggtaattatctcaaggtacaagttcttcagagtctagaaagcacattaaatcctccacagcttagagaccaatgctgagaatatgcaacctctttttatctctatttctccccctgttccaaaccaggttccaatgccaagaaaaacagggtagtggaatgggaagcttctgctgccaatggcacagatgaggaaaccaaactgtagctacagaggcaggctgacagagccacttgtagccagaagcagattgctggggggagcagctctctgttctgtccattttcttagggacagatgttattcctgtctgttccatcagcaggcaaatggggaaataatagaacagagacaatggaaagaaagtgagaagcaggcccagacagcagccactgagctccagtaattgtgggtggggtaggggagaaatctagctgctgctatcagatgcaatgtgaaataaagaaaaataatgtttgtggttcagttactagaatggataagatgactgtcaccctttggatagctcttctttatcctttaggacttggtcctaacttaggtctttcaggaagttttttcacctccccagtgcccaggctggagtaggtgtcccagtgtgccatgtgcacctctcctgtttatgctcatttcacaatgctgtaactagcagtgcatttccctgtccctcccactacattataagttccctgttggtagaagagctgaggcaggactagcttctctgtcataatgtaaaagagtcttggaacgtgtcctgggcccaggctctaaaccccctcatggcctttggaacaccaagctctgtgccaaagggtggaaggctgccctgccacaccacaatctaagcccagggcataaaacccctcgtggcttggatacaatccaaggctcagggcataaaatcccttgtggaattgcactggaatggcctctggaatgtgcacagacttgctggctccttgcttcttactctcccaggcttgtaaatatgttctccattatctcaggtagcagagcatattacatatgtgtcaaagaaaatgctaaaccatcacagctatgcttgatgcactgctacctttctacccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctactacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtcatacccccaacttccactcaacttccaaggcagataccatccctgtgaatctccacaacctatatgaaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgcggctaaagtgaaataataagtacagaaggccatactgtaaggtttggtatagaataggtgctcaacaaatgcttactatttatttacgtcatattcagacaactactacagtcaatctccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctgaaaggaatcagcattcaagggaatataattagaaaagaaaatttgccttaaagtccactgttactttgttctctctctctcgtctcctcttcccccttctctctcccccttcctctccccagttccgtcttcctctctccctctcccccctctctctccccttcttcccctctctcttccccctcttcaggccctctctatctcttccactccctctcccacctctctgcctctccctctcttctccctctctcctcttttctccccctcccgctctcactctcccccttactctttccctctccccccatcccccctccctgtcctgctatccctccctagccctctccctgcctccctctcccccaactctctctctcctgctttccccgcttcctcagggctttgcgtttctctacaacacagatgagcagatgaccctgtcagaaaaccaaaatggttttcattggtctattcaggagtttctagaaatacttctgactgagaggctctttgaataatttactcatctgagatcatttaaataatctatttgctcattttcataattgatggcaatggaaaactagcaagggtgcagcttttgtcttacatttataccacctgtcagcttaatcatgctcccatcaccctcagagagatccttaacaatttgggtttgcgactgggatggagaagaatgttccatatgaccgaatgtttgactctggctctattaaaatactgcttgggctcaagtcctgcctttaccactgtatggccttggacaagtcattcaacccatgttgcttccaatttctctcctataacatgaggatagaaataattatacttagaactggcatctatgtgtcagtgttctaagcacctgatatatcaccttgtttaattatcctaacaacctaggaggtcagtactattatggcctcccttttagatatgagaaaatgcagagaatgttgggagactgaaacaagattatccattgaaaacactctgcatggtgtctgacacacagtgggaactcaactaatggtagctgctgccctcatgatcatcccatccatcaagaacatcaccgtcatcaccatcatcatcaatcatctttatcattagtatccctatcaacgtatgttcccatagagatgtcttttctatgaactgcatttttttttgttttaagttctgaaatctgaaaaactttcagcagaatgttgctctgcaggagagcgcctgttcaactgctgttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgtgacctaacatattgtactgtgtgagtatttaaaatagtcactatgcgtgactctagggaagtcagatgattattttattttatttatattcacctttgctaaatcctgatgcacagatgataattttaaatgttttataatggctcaattttccctctctatggctcacatcatttgagaaacttaacgatcattatataaggaaacaaattaaattccacacagactctgctaaggttgatattaccaaacccattttataaaaaggaacttgactttaaatatggatttgggagaagaaagaaaagaagagaagaaaggaaggaggatgacagggaaggatgagagatgaacaatgtcatttacaggcatggcaaagctcttccagaaatacctaatctgaaaatacctaattagagacttacacctaaaaaaaaatttttttaatctatctaattcccctctgtcatgcatctgccagagaatcagtgcagccaatgccatggctttcagttctgtttctgaaatttctctcagattccgcggccactattcctccccatacctctcttccctctaacccaagccacgtaaataggcccttaaaaaatttcccagattcttgacaatcaccattttccttttaaagaagcagtgtagctcatgtctaagagtgcagacaattgggttccaaatcctggctttgaaatttactagctctgtgactctgagcaagttattgaatttctctgagcctcattccctccatttgcaaaagagggtaatagttgtatctgtattacagtcctgatatgaggattaaatgtatgcttaaaacctaataaatgttaaacaaatgtgagtgatgattattttttatgttgttctctcatctcaagctcttcaatagtgccctgaagattactgaattaagtgccataacctatcatttaaattctagcatagtcctttacccccataaagtttccttcaaaagatttgtactagtctgttgttgtgtagcaaattacctcaaacttacccatttgaaacaacacctgtttatgatctcacagttctgcaggtcagaagtcccagcgggctcagctgggtttttgctcagggtgtcacaaggccaaaatcatggcactacccaggctgggctcatatctggaggatcttggaagaatccacttccaagctcactcagattgttgggcaagctcacctccttggggttatatgtctgaggtcagctagggactgacagtgcctagaggcccctgcattccttatcatggagccccctcgatcctcaaatgtagaagtcagactaagcattctcacactccaaatttctttctgcaactattaggcttgtgtgaaactaattgcagttttcgctgttttttttaaatggcaaaacccacgattacttttgccccaacctaatagctgcacaaaactttctacttttaaaggggtcatgtgattgggtgaggctcgccccaataatctccttgttgagtaattcaaagtcaactgagaagtcctttctgccatgtggcctaataaaaccaaggagtgacagctcatcatgtcacatactcccaggggagaggcttagaaaaggccaagtgtcactggagaccattctaagaattctgcataccacacagctatgttccaatcacattgaactcttctccagatgggccttgggcactcttgcctctgaacctgactttttcccactgcatggaatggcctcctcacacatattcagaaatccaaatcttgcttattctcgtgagaccttgttcaaacgagaaatcctccatacaaacgcccttgattcttctgcctccctataacatctctcttctctaaacacctggagttgccaaaacatctttatggcacctcacatgctctcctgcagttacgagcatctcttagtgccccgttagactctaagtctcttgaaaaccagatgtcttatctgccttgcaaccctcagatatgacttgcacatagtgagtgctcaggaaattttctttgacaaataagtgtgtgaataaatatggattacataataccctaagttctattatctctgttgatgggacaaatttttaacaaaaaaatcatttaataacaatatctattgagaaaaatctaggtaacaggcactgaactacatctataaacagcgttttatttgccttgttattctctcatttgccagaagttattcaagatgcaacaagattccaatttccttctttccttttcctctgtagtttctcctaagcattgctactgagcagtatattccaaaggaagaaagaagcacaaaagctaagaagcaagaatcttgataacaggatgacctaaataaaaccatttcagggttacacagagtaagtctatgccctaaagcagtagctttacatctttaatgggcatgagaatcactagggaggcttataaaacatgcagattcagaatcagaaatgctgattccatagacttgaggcagggctaaggcctttacatctttcccaaggtgattctaatctaggtagcccaaggaactacacgtataaaaagcccatactaaaagatgctcctcatttggggaagttaatggggaaaagagtctttccattcattctccaaatccttattgagcctctgctattgaataccagagatataatggtaaaggagagactgaaaacacaccatgagctctcagtgctagccgtggccagaattcatggctttaccaatgggctgctattgtctttctaagcaaagagagttgtaatatgtttctccctgccggtagaatgtgtcacaatgttcttcaattttagcaatccacataatcgttctatcaattgtcatttactggtgtcctcacaattgcaatttttctccatgatttcttttacacaatcttcactgggatgtgtgcggagaagccaagaacaatgtttgcataaatacttccatcctctggctggatgaacttttttgaagactactgatatctcatacacacacacaacacacacacacacacacaaacacacacagaagcaaactgacactaacaacctgcatgttttcttgagatcttgaaactcactgggccctgctaggctaaatgtggtagtagtgatgggaaagagatggcaaggagagggagctaaaatacaataatttagataggagggagctatagcattctataattacaaatcacatcatgtaataattgcaccccacgcatcactatgcctcactagacctgatagcacaatgatacaccacagtcagaaccacagactcaagagagcaatcatagcttttgtaagatctcctttatcatatctgtactaggaatcctataactggaatctactttatttcacacaagacataacatatggggtgcatcccctcccttaatgagacaaattggaagatgaaactactgtagaccaaaaaatagaaggggccgggtgcggtgcctcatgcctgtaattccagcactctgggaggtcaagatgggaggactgtttgaggttaggagattgagaccagcctgggcagcatatcgagaacttgtgtctgcaaaagaaataaaaattagccaggcaaggtggtgtgcacttgtgtccccagctacttgggaggttgaggcaggaagaccccttaagcccaggaatttgaggctgtagtgggatatgattgtgcctgcactccagcctggtaacagagtgagaccatgtctctaaaaaaaagttaaaaattacaaggtctgggagatgcaataaatgcctataccctgagttctaattagctggtttcaggtagaatcaattgcatccagtgagaggaaaggaagcagacacctttctaagggtaggaggaggaactccctaaatttctcctctagaatacctccttcccgctgccagttgttccacatgatgtagtggtggtgaacacagccttcgggggcaggcggacctccacttacatccttcttccatcacacaccagctgggagatcttaagctggtcactaaccagagagaaactctggttctctgaaccagaacttccatctctgaagcagggagaagaatacctactttagaagtgctattaaacaaatacctactcagatgactaaatgagataatgaatgtaaaattgtcatcatagttattggtacagagtagctcttaataaatggcagctgaagtcgtcgataccaacagatcatagaggggtccatttgtgcactaggcccaaacccttgtggtgaagctgaaaaaacacagatgaaaggaacagaccttcccctcttggggattctagtctaagcgaagatgaataggcaagcaaacaatgccaaagcaagctgttaacactcttacgaattagtatacaggtctgcaggaatgaagtggaaaagggcagacccactttgagctacccagatatagaatcaatggaaagggtgtccttagcaaagaggacaaatgtttgaaggggcaggaacatcaggagcaggtgacagctgaatactagggcttgggggacactccggggataagaagaaagctttctgtgttggggtacgggcgaataaacatatccgtgggaggaagatgatgagtttgactttggacaaggtgatattgggtgtctgtgggtcagccacgtgtggtgctgtaggcaagtctggaggccgtgagacagatctgggctggagggagagatctggttgtatttctgtgcaaaatgcacctgaaaccaaatgtaaacagagtggtgaaaacaaaaagaaaaacagacccatcagagcgagaatgggacatttccttcaggaagacacaaggaagggtctccctaatgtcttctggaacatcggtatcatctttaattggatcttctctggggaataaaaggcttgttttactttaatatttatgtgttttgtcctatttacatttaaagtcaaaacttcaaaaatctttatttatctctctctttctcaatatatatcccttttaaagtttgtctaggatacactaattagttcagtttagcttttccacagtgtacaaatatatcaaaacgtcatgtgcactaaaaatatctacaatttttatttgttaacttaaacaaatttttaaaagctagcctgtatgtgtatataggtgtatgcataaacacacatatattttcattttaaagctattgtaaggccaggcgcagtggctcatgcctgtaatcccagcacattgggaagctgaagccggtggatcacctgaggtcaggggttcaagaccagcctggccaacatggtgaaacttcatctctactaaaaacacaaaagttagccaggagtggctgcacgtgtctgtaatgccagctattcgggaggctgagacaggagaattgcttgaacctgggaggcagaggttgcagtgagcccagatcgtgccactgtactccagcctgggtgacagtgtgagattctgtcttgaaataaataaataaataataaaataaacaaagctactataaccctaaaatggtaaccagaattattctcaaagcattttttttcaggtagaataagtagttcagcctagagcaatccaatttattactcaaggctcaactccaatacctctagctttacaaagaatttctctaagtgagaaattctcacttagagaatttctttttttttttttttttgagatggagtctcactctgtggcccaggctggagtgcagtggtgtgatctgggttcactgcaagctccgcctcctgggttcacgccattctcctgcctcagccttcagagtagctgggactacaggcacctaattttttttttgtatttttagtagagacggggtttcatcatgttagccaggatggtctccatctcctgacctcgtgatccacccacctcggcctcccaaagtgctgggattacaggtgtgagccaccgtgcccggctagagaatttcttgactggcccaagttcacccttctctccgcctatgtagcacttatagccatttgttccagggttggcttaattctctattatgagctacttgagaagacacatagtttcctacacatccttgtagcatccctggtacctaatgaactgctggccacagagctggcatacacgtggcattggttgtactagcctagactgctaattggcaggaagaccccttacacctaggaatttgaggctgtagggtcttctgaggctgaggttgaggcatctagggttttgtttttgagcatctctgggaagccttggactcatcaaactctaaggcagaccaaaatcactgaagaacaagggagagagaaaaggcatggaagtcccgatttgtgagagaaagtctgctccattctgagttctgtgtctgcagtatacaggcaggcctggtgtttggcgtctgtataatccacaccagccacctacaaaggcctggaaaaaagcaagtgcccctctaagggcttgtcgtgttttcccagacaccctcattacatgctgctgctttcagtgacgccactggctgacctcggagatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccctgagtgccaagaggatagagcaactacaggcagtatttgtgcattctaagctcaactcagcagcaattcccaaagctgccttttatgggaaattgctatgtttcaacaggaatttgaagaaaggcccacaaaatattaaaaggcatcttctgtatctggaaatggagtgtatcaagggcagctgtcacctgcactgcagtggcctccttgtgtaccagctccctggaagatgagtcagattctaaggtagcacagaaaattcacaggtgtgagtcaagcctgctccaggactggttaaaaccaaccaaagggaatgatttggtggctccaaaagtgaatcgcagattgtgtaacatcaaaaggttgaaaaccccaaaatgcaacaacataaggcagaaaggctccaactctctacctcctatggatgattagaaaaaaaacatgaattgcattttggctttacatgtgtaagaggaaaaaaaatcaggatttgaaagatggataagagaaagtaatgatataagaaaatattataggcaacaacaacaacaaaagcatattcaaagtcccaaatgcatgaaggaacccagtatatacattcatggagttgcaaatcacttgcatggtgggctacagggtgtataagagggaagaaaggaggttaaaaccaaggacagttaactagatgctaacactttccttaagcatgacagaagcccatagaatcccagccgactccatctccatatacacactaagatctaagtttcttgagtacagaaaatattttttctcttgtttatgatggactccaagcatcaaggatagggcctggtacacagtaggcacttaataactatttgttgaataaaaaaatgaatagacgaaccatgaagtcagggctccggtggatcaactgaaggatcaatacaagaggtgatcaataagcaatggatattgttattataattggtattcatgtcagggggttaaatatgaaagctcagtgaaaactgttagttaattgtgctgggtatcccgatctgaaggatttaaggttttgttgttttgttttgagacaaaaccttgctctgtcacccaggttgaagtgcagtggtgcgatctcagctcactgcaaccctcgcctcccaggttcaagtgattctcctgcctcagcctcctgagtagctgggattacaggcaccaccaccatgccgggctaattttttgtatttcagtagagacgagatttcatcatgttgcccaggttggtcttgaactcctgagctcaggcaatctgactgccttggcctcccaaagtgctaggattacaggcatgagccaccaagcccggcccggatttaggtttttttttaaactaagcacaatgacatacaacaaaatgaatggatcttgtgtcataatttgatgccttttgacaaatgttcaagataggaaataactgccatcactccagaaaattccctgtgcccctgtcctgtcaactgcactcacccacagaagcaaccactattctgatatctaaccccatagggaacgtttgcctcccttgaactttatgtaaatggaatcacacaatataatctttcatgtcttcacgtaatataatctttcgtgtctttctttgattccatataatgtttttcaattcatccatgttgttgtacatattactaggccattctgttttattaatataccataatttgttcattcatttccttgttgatggacattgaattatttctgatgttttgctataatgaataaagttgcaatgaacattcttgtacaagtattactttttggatatatgtttatctttctttgggataaataactaggagtaaaattgctggataagatttgtgtgtgtatgtgtacgtttattaaaaaacaaacaaaaaaaacacacacacagtttttggccaggcgcgtggctcacgcctgtgatctcagcactttgggaggctgaggcgggtggatcacttgaggtcaagagtctgagaccagcctggccaacatggtgcaactatctctaccaaaaatataaaaaattagcctctgtggtggcacatgcctgtaatcccagctactcaggggggctgaggtggagtctcgttctctcgcccaggctggagtgcagtagctcaatcttggctcaccggaacctccacctcccggattcaagtgattcttgtgcctcagcctcccaagcagctgggactacaggtgcacaccaccatgcccagctaatttttgtatttttagtagagacggggtttcaccatattggtcaggctggtctcgaactcctgacctcaggtggtccacctgccttggcctcccaaagtgttggaattacaagtgttagaaaataaaaaagagggctgggcacagtggctaacagtgtctttagatgagcaaaagtttttaattttgatgaagtacagtttatttactgcttaatggtttttcatatttggtttaagaaatctgaggctcacagatcacaaaaatattctcctacattttcttctagatagttttatctttcacatttaagcctgtaatctatttcaggtaattatgtgtgcatgcataatgtgagcaatgggtcaaggttttttttttccatgtagattgcctgtttatccaataccatttattaaaaagattttccttttccctgttgtcataatcattgatcaaaaatcatttgaatgtgcctatgtggatctattttcattatttcatcattaaataagatataagcttatttaatatatatattttatgcaccgtagtctaacttagaataagacagaaaaacttaaaaattgtcaaataaagcatctcatgatatgcgtatgtgcatataatatatataaatcgatatatatattataggtttttcatagataccctttatcagattgaggaatttaccatctttatcataactggatattgaattttgtcaaatgctttttccgcatctattgaaatgaccatatttccccctttactctgttaatgtggtaaattaatttaatttttaaatgttaaactaatcttgcattcctcagatagcccccacttatccatgatgtattatcctttttaaaatatattattacattatgattagtaacatattgaaaaactttgtatagagtgctgttatttcttttaaatgtttgttatagatagacgaagccatctaggccaggagtttctcttttgtctttttaaaatgggaaagtttttaggtatattttcagtttttcagcaaatatgagctattcagatcgtcaatacctacatctcagttgtagaaaattgtgtttcttcagaatttgcccattttatctatatcgttgaatttgttgtcataaatttttcataatattctttttatcttttaatgcctgtaggatctgtagtgtctgtaagtgatagtccctcttgcatttttaatattggcttatttgtgttttctttcttttgtgtgatcattattgctagcgactgtgaattttattagtcatttcaaagaactagcttttggctttgttgatttttttctatggcttgtgttccaccttgttgatttttacttgtgtatttatgatttttttcttctacttcatttgttcactttgctcttttctaacttctaaatttataagcttaaatcattgacactgaattcacactttccttttttattataagcagttaaagctatgaatttcttagtgtgccttcaatcttattcctcaaattttgatattttgtgttttcattatcattctgactaaagtattttctaatgtctttctgatttcttctttgacctataggtttagaagtgtgttgccatttccaaatatttggagattttctagatatatttttgttactaatttttattttaatgctgttatgatcaaagaatgcaccctccattatttcaattcttctaaacacattgagacttttgttttatgctccagaatgtagtctactttggtggatttcccatgtgcactcgaaaggctgtgcattttatagttgctgggtgtaggatgcaaaactttcctaagcttcctcctcactgttcttttctaggaatctgtcattgtctccccagagtcaatgcttctgtttgtatagtatttccccctgatttcagtcaattacattatgtctcccacagcacatcctatatcttccttccctctagggtcactcaggcctccatttgatgtactaagtgaagataaatttcaagatgctaaagtagttcagaggtcatgcattgcttgtcaaaaaacataacaaaaaaataagataacaacgtaacaacaaaggctttctgatcccttttattctactctttatacgaaattgtagcgactaacttaagcatttaattatggaggaggagggagggcaactgaaccagatattgtcattgtatgtatgagatcatctgtaaattccctgtgacatctctcctctctgacccaggtcatgacatgtatggtacataagatgatgatttttttctttgcaaacgattttttgtattttcaatagctaatatacatgtagttgaaaatatgctttataagaaaaataacctccctctctaactcatgatttacagaagtgatacatttaagtttttaaaattagtttatttaaagcaaaagactgagtacatgaaaatacagagggttcgttcatatggcaatgactatggtacacaattaggaagtttaggcaaacttctatgatcattgctacatagtcaacacttattagtgtaatgctgcaacccagacttcactgtctttaaattatccttagttcagacctttcctactgggatttgagaacagacatacagcgcaccacacaattaccacagttcacccagagaaagcattccaattgcaccttacagatttagtctgccttgttgcaagaaagacgtgctcttggctgtgagatgggatctagagcagctcaacaggaaatgcgtgggagaaagaagcactgtgagcccctttattgcccatgctttcttccctcccctgcattcagcacacagaaggatgctcaccttttcccattcccggtctttgttcagcacaatcaccaccagcctggggtgcacctggtagccttcctcagtgaaggataagtctttgccatcccatgtaacattgaccataaatctagaaaggggaagagagaaagacaaatttttaggaaagaattagagcaatcgaacaaataagtggatgccaccattaatggaatactgaaaaattataaacttacaatgctatattcatcacaagaagcctctctgcagaagtattaataaccatgcaaccattgctagttgaccatgctttagtaattgactgtaattaacacgtggaatgtaagctttttgtcctgccagattcatagacctatattcaaatgatcttcttacaggaagatctgaaaacacattctattatactctaacaaacttccctgaaggaagctgcttgctcataaaccacatggcattcaatgttgaaaaaatgacattccattattcattatttattcaactaatatatatgaagcatttgctatatgtcaggactcagctagttggttcagggtaaataagaaaatgaacataattcccaccctcaagaagtttagagtctaagggggaggatagtcatgaattgattaaacacagatttatgacaaatgatacaagggacgggagagtatgctataagaaagtgaaataggggtgaggcaaggctgaggaagtgcagcttgacctgaaggctcaattggcattaactaggcaagaaaagacacaaacaggcaaaagaggcaacatgtgcaaagactctgtggtgtgcataccaggaactgaatgcagaccagagaggctgaagcagagaaagacaggaaaatgtgagatcaggtgaggctgagaagatgaataggaacagaaagtgcaggattttagagaccatgttaaatgtctgtcttaaaaccgtgggaaggtgcaggcatggtggctcacacctgtaatcccagcactttgggaggctgaggtaggggaatcacctgaagtcaggagttcgagaccagcctgaccaacatggagaaaccccgtctctactaaaaatacaaaaaaattagctgggcatggtggtgcaaacctgtattcccagctactcagaaggctgaggcaggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattggaggggaaccagagcgggtacagagggactacttatgctattcttacaaaccaggtcaaagataatggtggctttgactctggttgtggccaaagaagaagagaaggaggaagagaaaaagcaacagcaaacaagaccgagtggagagatatttaggaggtatttagtgaaagattagatgaggggaagggagaaagaggcatcaacgatgactcctagaatctaccttatataacatgtataaacttaatttttggtctaggtgttttcattgcaggtaacatctatctgccttacaacatttataccctcatcactcctcaaagccaccttggcctgtactcaggctgaactcagagagccaaggcagacttcatctcccagatttcgggtgagaggttccccaagggatccgctctccttgcagcttgagaaaaatgtgatgtcgttaaagacatctgagacaacatggtggtggccactcagcagacacaagatacatccaatatggtggattgaagcattcaaagacttccccagaaagatactgtgtcacttgcttcatattccattaacatccagagatgctaaaaagtgaaaaaaaaaaaaaaaaagaagaagaagaagaagagaactaggctacaagaaattttaagaagagacactggcctaatgggtcacatgtacatccctggaccagcatggtgcagaagcgactgatgggggtgttgtgtgggggagaatctggtttccaaggacaaagtgaagaaattggggaaaaggaaaagagcaaatattgtgtatttattcaacagaccattcgggtcattgaaaatcatgtttttgaagacaaattaatgatgcagagaaaatgcttactatttaatgttaaagaagcagaaaagaggataaaaacagggcttgtctatgtctaaaagggttatgggtatttttcatttttttgtgtgtgtatctttgtattcttcaagttctctgcaatcaaatactttaacaaacagaaaactaaaacactgctattctagaaggaacaaaggataatcactattctatctggtttatttggggtatctcttatcacttcctagaaaggttttttgttttttgtttttatttttgttattttttttaagacggagtctcactctgtagcccaggctgtagtgcattggcacaatcttggctcactgcaacctccgcctcccaggttcaaatgattctcctgcctcagccttccaagtagctagggttacaggtgcccaccactatgcccagctaatttttgtatttttagtagatacagggttttgccatgttgaccaggctggtcccgaactcctgacctcaggtgatccgcctgcctctggctcccaaagtgctgggattacaggcatgagccaccacacctgccggaaggatattttcttgatttaacaactaattactctatttattatagagacgacggtcaaagaaagcatatttactgtatgcctggtatataggtcagggcttatagtaagtcttatagatacagaaataaaaaacacagtgtttgtcttctttcttacccacattcttataattcaatggcatagacacataaacaatgacagtacctataatgccacttattcactgatggagagtaaatgtaagaaggtgagacaacacagacaaaagggtccctaactcaacctggggaatctggggagggcttcccagggaatcttaatgggtgaaggggttgaggcaggagaaagcattctgggcagaggcatcatcttaagtaaagagtcagcaaaggtagtaacacacgctagaggaagtaggaaacggcttagtaaggcagatggttatgttatgtgcagtgggatgagtctgcagaggatccctgaagccagatcataatggacacactgaagggtttggatttgttcagaaggtcatggtgagccaggaaagattttaagtagaggagtgatatactcagatttgcagccaataggggcagaagtgaaaatgcttctctgcacttgaggggacttgaacatttttgttcacggcttaaaaaccattcattatctagacaattgaaacttttttttctctcttccttctcccctttgatgtttcctggctggagtttgatgaactaaatgaacatggtccagatacacacagctaggtgtgctccacctcacacctcttattgagactctaaagaagatatttgcatggactgtttagtggagaactggagtcaaattcctcattattagcaggacttcaaagtaactaattgagcctaagttaagctgtttttattttttaagctgacattttggttccatttcccagggttatttttagccccgtcacattgtctggcatactgtgggggctcagttaatgtttggcaagtatgttgacagatcatcaccaaagggaaatccacccatccatacattcatccatctatatatctacccttccaaacatctgtcaatgcagtcattcatctatccatcaatccatcaatacatttacctgtccattcatccatctatcaatacattcatcaatccattaatccatccatccatccatctatccgtcaatacattcattaatacgttcatccattcttccatccattaggcatgtttgagcatctcctatgtatcacaccctgtaccagaactatgccatgaaaatgatacaaaaatgaccaaaaatacttaatttttcaaggttggggagagggacacacaaaataactataacgaagaacaataagtgtaaaaatagagatatggactaagttgttggaaagcataagagaagcagtggctaattctatggtgattccatgactggaaaaaggaaacaaagttaaagggatttgggttgtgctgagaaggaagaggaaggaaaagttgagcagctcttgctcatgcacatggagaaaatgcaaagtccaaggcagaaaaccctgaaacatcatgatgtgttcaatgagctgccgtcagttcacaataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcagtacaaaaactaccgacaaagaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaaccttcacctcccaggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaatttcccatctccatgttctccacttgttcccttttcttccatttggtagtaaaatcagatggaattagcagagtgattactgagacgcaaacactgttcttcagattatatgaaaataactatgcagaaatcctcatgcttcagatttttctgtgttcctctaagattcaatattctgggtgaatgactccatatactcaatgttaatattgtctttttctattaaaagtcttcagtcccttgggaggggggaaaaaaaaacctctaacagaaatttctgctgaacagtaatttcattatgaagttggcagggagcaagtacctattaccttcaattcccccacccaatttctaggaaggacaatccatatttccatgggctttcttcccatttaaacttgctccagagcagagttctttacctagggaaataccattttacaccacattgatcagttcccattaacacctgctgggcacttgtattaaacagtaaaatcttgtcattgttttgcttatctctacaaaattgatcataaagctttagtggtcagataaaatgtcagaaattctgactgcttctaagcctcaaattacagcttcaatatctccatcaggagcaataagtacacagaagcatgctggcaaatagagaaggggaagactctagtgatttgccaagacgacttctgtgttgtcatccactggtggtaaagtgctaagttgttttttattgccagtgacagtcacaacactaaatacatatatatttacatattttatatatataaaaaaatacataaaatacgtacatatatatacacatttcctctggtatttacagtattaagtgtatgaagctgaagtccaggttaaataaacattcctcttccccttgtgttttgtgctctatgaatggtgatgcatggtgatcagagataacattgaaaaataggtagacaatatttcctatatttcctatattatgattgaatataaacggggccagaattgtccaattctcactaggcctgctatcacgttagatagccagccaccaaccacgtgtagctattgagcatttgaaatgtggttagtctgaattgaaatgtgccatccatgtaaaaatacacacagaattttgaagacttcgtatttttcaaaagagtaaaaggtctcataaataattttaggttgatttcatgttggagtagtttaggcatgttgggttaaataaaatatattattaaaattaattttatctgcttctcttcacttttttaatgggctaccagaaaatttaagttacatgtgacttgcattatatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtgctgaacatgtgcagaatgaataaaagaataacttgctgcttctatgttgttgaggtttcatgacatcgaggaaagagaataggctttacagtgagacagtacctggcaccttgggcagcgtatttaaaatctactgagcctccatttcctttttttttttttttttttttgcaaaaatggattaagttaaaccatacagactagccatgacagtttcatatggtttaacctaacttcatagttcgcataaaatgcctagcacagtgcctggtatacagctattaataaatagtagttaacattgatgcaaattttccatgcagttttcactctttttccaccctgtcatattttctaacaccctactacaaatgcaatgctttttaaagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattcactatttcccccttagactttaattctcttactgtttcacaaatgccaccataacccatttagtgtttctcaattttcggttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgttttttttttttctcttacaagcattctcctggtgtttgcaaatcccttcaactttgatgtctatcttagtgctttctcatcttccattaactattccctcatgggcgcaaatgaatcctcatccctctttagtacaacttcactctacttttgccagttttcaattcccaactcatccacctcctccttctcttcttcctctgaatatccttgcgctgtcttttgacggcagcaccttcctctttgccctggtgctcaatttcatatacagtactcattggtggtttcctgttccccgtgaacaattaaaaagtcttaacagcagagccagaacttaaacatcaaggcagagaaggccaggcgcggtggctcgcacctgtaatcccagcactttgggatgccaaggcaggtggatcacctgaagtcaggagtttgagaccagcctggccaacatggtgaaactccatctctactaaaaataccaaaaattagccaagcgtagtggcaggcatctataatcccagctactcatgtggctgagacaggagaaccacttgaatccaggaggtggaggttgtggtgagtggagatcgcaccattgcactctagcctgggcaacaagagcaaaactccgtctcaaaaaaaaaaaaaaaaaaaaaaaaaagtcaagacagaaaaataataactccaacacagagatactctaaaatgggctcagaaaccacaacataaagaaacagaaagaagaaaaggatttttataaggagaaaagtattgtttattctttcaacacaaattctattgtggtcaattaaaaaaataatgttagttgtcttggctgagcaatactgaattttaaagattttaggacacaaaatagaaatcttcttaagggcaggggtctttgttctgatcactgcaactctaaaacacctagaagagggtgtgtcctgacttttaagccagagcttaaaagtaactgtggaataaatgaaaaaatgaatgagcaggcataggtctctaggatcctgcacactaaatatttgattccagtacaacaactgccaagaggcaatattgcaagaattggatagcctgagttagaattcaattttgtggctttcaacctcaggtaagtatcctcagttctcagagtatttgtttccttttctgtaaaagtgaggtcataacagccatgtcactgggtaattatagggatcacactaaatgacgtctaatgagatacacaacgtgataaaggccagcagagtgcttggcacattatgggtgtctgctaaactatggtaggggtagcagtagttgtcatggttttatataattgtctttcttcctcctaaaatttggggtcaaaagctttcttttaaatgctggagaatcattttggctactaattccagtccccgaagggaggcaatgagagctcgtctaggccctaccccaaggagagaggaggagctcatttgattgttcagagctcacagcaccccctggactgggcttactggtagatgaagcttctatggtgcaaagcctgtaatccatgtgccaccctgggcatccaactctattcagggagcacacctgagtcaagggtgactccttaaggagaggaccctatatgctgtcttttgtaatacaaccgctatgtctaaaacttgaggtaggttaggacaaagcttttttctgtaaatatgactctcctcctcccaactccacagagcatacctgaaactttgacccaactggccaaagatttcaactagaagcagggtgtatagagtagggtctaagatgcatgtcctaattctactttattgggagttattggaattctgaatgaccattaataaagtggttcttcgaatctcaggctgctcttggaacctggggtgaggaatctggaaatgctgggtagtatttataacactgttaaaatagcaccaaatgcgtcaccattaacctctcatgactaaggatcacctaaccactttgaaccagctggcacaagagccagtggaaccagctcacataatgagcttctaatccaaatgagcagaaaaaaatgtatgtaacgtggcgtgcatttccaagttcactcaatcacctgtgcctatgctgccaaattattcaagatctccaagtggcagatgtgcgtgcatgttgctcttccaaccaaaaactatagaatgagatgatatggatcaattgacattcaattcaaggtgcgatttttatttcagaatttctggatattcacatactggaatatagaattcataaaagcagggattttgcctggtttttccttctgctgctttttctcccttgaagaacctagaatactacctggtataaagtagatgctcaatgcaaatttgtggaatgaacaaaagtctcaactctctgtctttttgttttctttcgtttttccttttgatgatgagccctactttgtctctctgtccagtgggtgtctacctgctttctgtgaattacaactagacatccagtgaggtaactcaaaggcagagaggaaaggtcgggggtgatatgccaatgggactctaacattcctaactccacttacatcgttaatatgttgttcttttttatacgatattatttggggaaaatacatattatatatatatttttgagacacagtcttgtctgtcaccccagctggagtgcaatggtgcgacctcggctcactgcaaactccacatcccgggttcaagtgattctcgtgcctcagcctcccgagtagctgagattacaggtgtgcaacaccacacctggctaattgtttgtatttttagtagagaaggggttggtcaggctggtctcaaactcctgacctcaaatgctccatctgcctcggcctcccaaagtgctgggattacaggcatgagccaccacatcccacgcctgaccagggaaaatatctttatattaatcaattaaacaaataaactagaagacaattaagatatttgctcatccatgctgctacaaaagaactctggtcttcaaatcaggagacctagaatcttgtcctgtctccctgaatatgtgagtaagagcgatcacttaaggataagggactaaaatgtatttagcctctaatatatgttgaatggtgtgccagatactttccatatgttacctgaattctcacccaaagaactaagtgcagattttctcattttacagagagaaaacagaggtgggttttataatggtgtgaaaagctatacgggtcaagagacttctggttgttcatcaatatcctcttttcttctgccttagtaacagaaattctatttttagaggggcacagaacctccaataataaagcttacatttctagcttccctagtagctaggcatgaccctatgacaattttctggataataggaagacagaaggtatgatatgcataacttataggaagtactgtaaaagaaggaggtgagcccgtctttgttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctgagttaagcagtcaactggttatttgaaccaaaatctttcagatttcaaaggctttgaattaaggtgcaccagcactcatttaacctccctacacctcagttgccctctctgaaaaatgggggggtggtaccacacacttctttatttttccaactctacaatatttaattttctctcctcatcttcccctactcccatgaatacacaatgcatttggtcctaaccccatctcttagtatatgctgttcctcccacccagaatgcctttctgcctcatcctcttcagtctaaacccagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatccgccacctcggcctcccaaagtgctgggattacaggcgtgagtcaccgtgcccggcctctcttggttttcttaatccattcctcatgtgacagcacttagcaatacattgcctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttgacaccaaacacaaggaaggctgagcaaggacaataagccaggccacaaatctttgtccatattatttttctgcagctgtaattcctgttcattccctgcatcaggcttattggccacccctcatgatcatctcaaataatacctcttccacaaagtattacttgactccttcaggttagacgcatcctcttccaactctcaacccctgttcttcatgtggcacacaccacttagagggcaccttctttatttatgttggtcccaaccactcaggactaattttaaaaagacacctctttctgaagaccctttactaccatttgccaaaacaactgtcaaaataaaacacaaatgtttgatgaagctgatatgaagggtgctcctggacttgtgtaattcatagcctgaacaatgttatcacctctcccagactgtcaactccctgaggataagaattcataactcagtaccctgaactctgggagcactgtgagttgcagagagagtggatttagagacaggcaaactgaagttcagttttaaatccacaactgttggtgtttatacccttaaggaaatcaagttattccagactcagctcacttctgtgtcaatgggggtaaggccgctgttttcaccagttcaggctgctataccaaactatcacagtgtgggtggcttaactaacaaacatttgcatctcacagttctggaagctggaaagttcaagatcaaggcaccagcagatttggtgtctggtgaaagccctcttgcctgtttacagaaggctgtcttcctaaagtgtactcacatggtggagagagatctacttcatgtctcctcctctttttctttttctttttcttttcttttcttttgagacagagtcttgctctgtcacccagcctggagtgcagcagcgtgatctcagcttactgcaacctccacctcccgggttcaagcaattctcatgtctctgtctccccagtagctgggattacaggtgtgcaccaccaagcccagctaattttttgcattattaatgaagacagggtttttctatgtgggccaggctgctctcagtctcctggcctcaagtgatctgtccacctcagcctcccaaagtgctgggattacaagggtgagccaccgtgcctggctcttcctctttttataagggcattagttccattgcaagggccccaccctcatgacatcatctaaccctaattacctcccaaagccccacctccagataccatccctctggggattagggtttcaacataaactttcagtccataacaaccacacagcactgttgcgaagtttcatggtggcatcatgagagttagaaggggtcctatgataagcacattgtttttgattgacatccagtagtagtgtgaccaaccatcccagttgtcccagcactgaggtgtttcctttggcatgaaaatttcaatgctaaaaccaaaaccataaattatggaccacaaattaagagtttgatccactaagaaatataccaaaaggacagctatagaaaggcttcaaatctacttcttagtaaacacatcacttcaataaacatccattgaacatctactttatgctagcaaagtataggaattaaagaggtaagtaaaaattgtgtggtcctttctctgcaatcatttagagtttaagggaaaggcagatcctatgcaaataattacaataaatggcaatatgtctgcagctaatgttcctgttgctgtaagaacattaggagggggacctgacccatcagaatactggttaatcttccattactccatttctacttgcttttttcagggcaaacaccaagttgatttatcagaaagaatacaaatttctcatgcttttcagaactgggcagataatatcaatgagtaaaacgagccaggtgcaagatgataacagtggtgaaaatcttagctaaaggcattcaaattcatttaaatgtaaatgaaataaaaccgatctactggctgctcatttggactgtctgttctaaacgaactgaaaaatattcatgttccttcctctcgcaaaaacctaggcttccttctataccagtacagttcacgggactgcatcccttctggggcagagcgatgtgcctatggatatacaataagcccggatcttcgaaaaagtcctcccttatgtatatcagaacacttatttgtttccctggccataaaaatatatacaagggggaggggtgcacctgtcccatggcggatcaattagattctgtctcctaggaatttgaaagttgataggtaagacacacagaccaggaattgttggctctaaaccaatgtaatagtgactctccttcgtcgaggaatgttgcctcaccttatgacctttccaagattagttgctcaacttatactttgatttttaaaaggtctagtaaagccccaaacaatattttctattgtttctccttcattaccttttaattaaattaagctaatcaggctttatttctgttgcttgctaccaaaatgtctttcactttgttcctacctgcactataacatctgtactgctattcagattcctacatttcatcctccatactcatatcaagcccacttgccagatgaaatgttcccacacctcagttctgatcatgtgccacccttctcaaaaccctgaaatggatccccactgtccaaaaataaaatccatgctccttggcaactttaatttttccaaccttccatcctaaaactgttcttaacagtatcctgcattggagcaaacccaaaccactcatggtatcccagtaaagtcttgtgattttccacttcttagcttttgttcctacacctccctccactggaaatgcagtcatagctgttgtttctggttactttcatttcctgataatagatcttcccccacgaaccctggagggcatctctggccacagagattggttcagggatcggtacgtgactcaatctcattcaaacacatttcttctctgggaattttttattgcaactagaagggatcactgtctttctggattaaaaaagtatgtgaatcaatacttagtttagatgagttcattccctatctcctggaggcaaacaactcaccttaacagggagaaatatggaaaggagaggaagacctgaagacaccgtttgagcctggatctagacacgcaagataacaagtccatcctttctagttgaatggaccaataaatcattttgcacttttttgtgcctaagttaacaagaatttactttctctcagtgaaaatcacaaatttttgtttttgttttgttttgttttcaagatagggtcttgctgtgttgcccaggctggagtgcagtggcacaatcacagctcactgcggcctcaacctccggggctcaagtgatcctcctacctcagcctccttagtagctaggtaatttctgtatttcttgtagacagggtttcaccacattgctcaggctggtcatgaacccttggactcgagcaatctgcccaccttggcctcccaaagtgctgggattacaggcatgaatcacgatgcctgaccacaaaagtcttgtttttctattcagccatcgaaggacatttaggtgttttacagtttggggcaattatgaaaagagattataaacatttgtgcacaggtttttgtgtgaccataggttaaatacctaagagtgagatcgttgtatggataaacaatgaaatacaatatgggaatacaaacaatgaattatagaaacacagaacagcttgaatgaattgcagaggcattctactgattgacggaagtgaccctcagaaggttacacactgtatgattctatcttatatgacattctccgaaacccaaaactacagacacagagaagagatcagtgattgtgtgactagagcagaaagtgtggctgtaagtagacatgtaagggattttgggggctggtgtgatggaacggctctgaatcctgattgcagtcatgattatacgaatctgtgtgccaagaatcatacagtcatgcctccaacagtcaattttactagatattatttttaaaaataaaatttaaaattttcattaaaaaataaaagaaaataaagcaaaatcacaagtctcatttaaatacaaagatctgtctcgcctaaatattcacatgttcaaatcctccaaaactgagcagagagtccaccttttcccaaaaggctcactgagcttccagcctccactccctcctcaaaactcccctcacttcctctgcagctccatttccaccttagagtttttcaaacacatacattctcttctttgctggagggtaagctcccgggaaacagggatcatgtctgagccctcgctgcgtgccctcacccctgcacagtgtctggcatgtggtaggcggtcagtgaccatttgctgaatgagcaggagcagattttcatctggccggagctggagtcctgagcagcgttgagaatgtcccggtgtgctggatggcatgtgagaaccatcaggacagagttcactgtattctggcctaaatagaggtctgaactctgccgggcctcataatgaaacttgacagcactatgtacattagcagtaataatgtttcacacccggacatggatttctggtgtggaaatgtgtcccctaaaagactaagctctgcaagtcccagtcactgctctgatattcatatcttcatccataattgcaaggtcaccctcttggtgggagaagagaatgatgtgtttaccacctaaagggcaaaggaactgctgggtggaggaggagttttgttttgttttgttttgtttttctgtataaatggtaaaaagaatatagcttttttttctttttactatagtccttcttccagttttttttcccaaatagctataaagggttaatcttacaactacagagaaataattgtggggagagtaggaggaagagaaagagggaacaaaggaggagaaagaggaaaagaagagaagtcaaagagaagaaaacccaggggaagaaggagaagaagaagacagaccaacaggagagtaaagggagaagtgtgggaaaaggaaaagggctgttttcttacacttgataatgaaacaaaatggagtttgaagcccagcagagcccttcaggaaagctggccagggctgtgtgggaggagatcctcacgtcagtacgatgagagcaagagagagtggcaagatggattgcgtccagagctgggcgagcagcaaacaggaagggagcagtgaggggatgcaccacaccgtggcctggcaccaggccctccctggtgacattgggaaagtaggtcagtttcagagctggctgggggatgaatggtcagccaggagcaagtggtgggaattaaagatgctgagtgagaggttgacttaagcatgggatctaggagacagggagtgttattagtctgtttttcacactgctgataaagacatacctgaactgggaagaaaaagaggtttaatggacttataattccatgtggctggggaggcctcacaatcatggtggaaggcaaggaggaccaagtcatgtcttacatggaagggagcaggcaaaaagagtttgtgcagggaaactccacctttttaaaaccatcagatctcatgagacttattcactatcacaagaaaagcatgggaaaaacccgcccctatgattcaattacctcccaccaggtccttcccacaacatgtggtaattcaagatgagatatgggtggggacaatgccaaaccatatcagggagcttccctagcacaacagaaagaatgaaagccagccctaggttgagctgtccagtagatctttctagcacaatggcaatatatctgtcacatccagtatggcagccactagtcacctgttgccattgagcaactgaaatgtggatagtgtgactgaggatatgaattttccattttattttacttaatttccatttaaatagccacatatggctagtggctggctgtcatatcagatagcttaagtacagagaaaagagctgtgtggatcacattcaaggagaaattgattgccaagaggatcccaaaaggctgttttctgaaatgccttaagtgtatttgagatggtacacagatgcatttagatggcacatgggcaaactttatttttagaattagattttattattttcatgtatattggaaaaatggaactagcatctcaaacccactgtttcatatatatcgttgcttaagaagacgctatggtggaattttatgtctctaaaagattaggtcaatgtaggtaaaaagtactatgttaacaataccacagagggcttacagatctagcaaaaagtaatacatgtatttcatgtaaacggaatcatacactatgtggccttttgtgcctggcctctttcacgtagcctaatgttttcaaggttcatcaatgttggaaaacatatttcattcctttatggctcatattctatagtatggacaaaaccacattaagttcatccatcaaatgtctgttgatggacatctaggtttacactttgggttactatgaacagtgcttctaggaacattctagtacaagtttttcagtttttgtttgaatacctatttttaatttggggaggtatctaactagaagtagaatcttttaggggtagggtaatgaggtggttctgaaactagatagtggtgatggttgtacaacattgtgaatgcacttaatgccactgaattatacagtttaaattgttaaaatggcaaattttttgttttctgtatttttccacaacaaagaatcattttaaatgaaagtaacaaagaaagcaagcagatggctgaatagaactgagctaattcaaggatacaataagtagttgaaaagcagtcatagctgagatatgagatttaaactcatatttgagtctcatatgaagtctcagagttcttttttttttttttttttttgagacggagtcttgccgttgcccaggctggagtgcagtggtgcgatctcggctcactgcaacctctgcctcccaggtttaagtgattctcctgcctcagcctcctgagtagctgggactacaggtgcccaccactacacctggctaatttttgtatttttagtagaaatggagtttcaccatgttggccagtctggcctcaaactcctgacctcagaccatctgcctgccttggcctcccaaagtgctgggattacaggcatgagccactgcacccagccttagagttcttttgattcaatcttctgcccctgaatcatttctacaatacctctggcagataggtgggcctatttttctgcttgcctgcttccatggagtaaagacctcagtacctctccaaaacaaccagtatcattggtgtatagatacacattttagaaaggtcttctttactttaactaaaaaaaaaaaatccatcttgtaattttcacattttatcctatagtccccagaattatccaaaataatgtattcctactatgtgcctggctaacagcacaggagctaacagcagccttaaataggagtgacagcaaagagttagcggaggtcagcccgtgtagagaagtttccaaaatgaccataagctgagtgtggtggctcacacttgtaatcacagcattctgggaggccaaggtgggagaatcacttgaggccaggagtttgagaccagcttgggtaacatagagagatgctcgtctctaaaataaacaaacaaaatggtcataaaatgaatgaaaggaacagtgaaacacagtgattacatgcactagctctggagccagaaaaccttaaatttatatgctaactcagctagttcctagtgttagcgatcttgggcaagttatttaactatccgtagcctgtttcttgatcagtaaaatgggcataatcatagcagccatgccataggtttgtcatgagtataaaatgagaattcatcgagagtcctgagcaccatcccaatccctgtatccagtggctctcattaatattagcccatgaatgttaacaatgccctccaacttaggaacaaggaagtgcatttggaaaaacatagctctacaaaggtctgtctcctaacctgtgatggccatttacccatcatgtaacagggagaagcacatgattataatgtctagaaaattttaaataattctacagaaaaaaacctgagtataaaggttgagtgaacacttttacacttttgggaagtttctatgacttatttaagtgatgattcccacccttagtcaagctgaaaagcagctcctaaagggtgagaggcattaaggtattgtgcttaagagcatgactgggcaagctattcactctgcatcttagttttctcaactgtaagatggggttaatatccctacctcatagtgttggtgggaggattaaatgagttagtacctgtaatgtgctggcacacagtgagcacaaaatatgtgttaactatgatgaggatgatggtgatggtggtgatggtgatgatggtggtgatggtaatgacgatgacgataaaggaaaaggagaaggaagaagaagaatggggaaaaaaaggaagaagatgttggtaattatggcaatgatgatgatggcaatgatgatagataatgatgttggtgatggtgtgatgttgatagcaatggtggtagtgattatggagatgatgctataaatggtgatggcaatgatgtgatgttgatgatgatgacgatgataccaatgtcggcatcatttagtctctgccctttccagaaccatggttccagaaacaccattttcagaacgtagcccctgatgaaatgcatataaaagctttatgaagctgcaaaaggaataatgaaaagataaagcactcttcttaaaattcagagtaagtgggtggggtggggggagggtagtacaaagaagtggttaagaacagaagctttggacttaagagtccttgctttgtatctcagtattgctagttatgagtctgcctctttaattgtgccaactgggattcatgtttaaaatctgcataatggggataataaaaatactcatatggagtatctctgcgtattaaaagggcaatatgcacaaaacactttgtagagagcctggaacatagtaactgaagaataaacattagttatcactggtattaatgggcacaattaaaggtgaatgatctgagccaaggaacaaatgctattgaatttcatatctaaaaggcagtaatagctgtgctgttcagcaaaagtggatgggaggattccaaggcagataattcagctggacccaaatagtctccacatagaagagttttaaggttatctatctaaaccaacagaactgctccctctgcccttggcctcgccatacattgcagaaactcttcccagtcttcctgccagaagattccagtgtccacatgatttctctccacttctttggagggtcccttccactgatagcttaaagtgtcagcaagagtttcctttcactgaaccacagttatttccttgaagcttcaacccactagctctagttctctactgtaagcaaaggagactaattctactacaatttccggatggcagtcctttaaaactctgaagccagttcttgggtcactccttatgagtctcctctagggaaacatttctcataagacacatagtagatatgggtgctctatttcattcaaaaatatacatatagagtcttcactctttttctccagacaggatcttgaatttgcagaatgagattctattccagggacctttatgtaaagatttatagacatttgctacaacgcattgtgcaaccttgtattttaggtcaaataagtaattgaaacaagtttctttatgtttcccctctatatagaaataattaataataatattaaattgagggtccaacatcggctaggcacagtgctgggtgtttaacataagttatcgcattttatacttcagcagctctggaactaagcagctaatgcattcaattgagagagtgtttgcatgtttcggaaattgggccttgtatcctggaaaagagctatattctacgcttcatttacacttcactcatcaaaacactctttggtaagagctatttgatgttctaggtccaactttttttttagcttttgcctttgagaggtcatgttttgcattctttgactcaatcctcaaggctctgagcctgcttaaaatgtagaaggcagataacgtttgggcttgaagtttgaaataacatttttttttccatttctcctttgggagggatattgtatttcacccacaggggttctttttacttgttgctgattttcaaaagaaaaaaagaaaagaacaaaattacaaaatccattacgtgaaggcattagaactgagtgtgaaaaacaatttagaatagaggctcccaagaatgtttgatttggagagaactagaaaatcattcttggttaaaaaaaaaaaaaagatgcagttccagtattagaataaaatcagacactaatttcttccagctaaagtacagccaagagtcaaaatgccaagtcatcatttaaaaaaacggcaaatcttagtatttctttcctggacaaaaacacctaggaagacaataaaactttacagaactgccagttttcaacatgctggcagcaaaacccagcagatgcaccaacaagaaaggcagacctaaaccagcctagcaggggcatcatttggcaaagggacagcctgccaccatactggtttctatttcagataacaaaattgtccaatagtgtctaatagagttaactcaaccagctgtgtggctgacaggcctgcacctgctttcagtatcagttctggcttctgaacagcacaggctattccagttcttctcaccgtgttaaaccacagaaaatttcccaatgcacaagttctgaaactatcttcaacgcatacgcatttgttttgctgtggctcagaagttaggcttattgaagatggaaagatggtcccagagagaacaaagtgggaacgtaaggggctcccagacccaaagctgaggaagacgacagtgaattgaaacttgccattaaggctataacagcttaatcacctggatatgatagcagcagttagacaagccacaaagagactcaactgaaagctgaagcattgtgctacaagacagctaaggggcagaagagccaacagcaacattccccacatgtgggaaggggcatatgtttccatttatttacagcctattgattatgcagcttttttttttttttttttttttttttttttttttttttttttttttaatgagacggaatctcactctttcatccaggctggagtgcagtggcgcgatctcgtctcactgcaagctccgcctcccgggttcacgccattctcctgcctcagcctccctagtagctgggactacaggcaactgccactgcacccggctaattttttgtatttttagtagagatggggtttcaccatgttagctaggatggtcttgatctcctgacctcatgatccgcccgcctcagcctccgaaagtgctgggattacaggcgtgagccaccactcccggccaactatacagaattcttaataaggcaagctgaagctgacggcaatttacaagtcagggaaataagaatcaactggtcaaggaacacatcaaaactgggaggacttgaatcaagtccaccacccttaataatagccaccttccttaagaacagcacagacctacacaactatccaaatgttctaataaaggtagaaaatacatacaaacaagtatttttctgtgaaagcagctttatggtaagattatttatcaaggccattgccccaattacttgtttctacttatttgaacagagacagtgtaatggaatcctgctcctaaaacttgtatgtttttttaaccaatggtaagagatgggactcacaactcacagttgctctgtccaatgaattgatgtaattgatgtcattgttattaatattagaagtacaccatcaatggaggtagtttaggtggtggtgacaagcactgactctggagttaaattatttgggtttgtgaactgtctctgcaacttgctacttatataaactagttgttatttcacctctttgagcctccgttttttcatctgttaaatggagatactaatggcacctacatgacaggtttgttgtgagaattagattgattaataaatagaatttagcacagtatgccagacacactctaggcacttgataaatgctaattactgtagatgtgataatacctttggttgttgttaattaatcaacatctgtacttccttcctgggattattgagagtgctgcaacaatttctcatctgccaattatttgccaactttgtcttctggagttggaggcataagagttaggtcaatctctttgtgtaatcttggttatatgatgtcacctctgtgaacattatctgtaaaattggaataatcccatgcaactcaaagaattgttatgaggattcaagattttgtatatgagtctaaaacactatataacattattgtaataattattaattatgtctaattaggagggtaataaagcaaaatgatcccatgaccccacagatcctcccaacagtcaaaagcttcatgacatgagtccttggaaaaaaagaagagaaagttgcattaaacatcacccaacttctcaagagaaccagaaattgtgagtaggagcttttcatacaccctgaatctgccggcacgtataaatcgaggtcttctcattcttccctcattttcaataccacttattgggaaggaaggtactgaaatgaaaacaatttggaaccaaaaggcacaactctcagagccacagcgatacagtgacaagtgaaatgggctttctaatagtatcctgctgcggattaacagacacctggtattccacctcggaggtggctggtgatgcagccttcttcactaggagtcaacggtccactcctagctctttttccaccatcctcccttttccaacctttcaaggcatgacctcttttccaccagttcctccccgccacccacatcccatatattaacagaagcccttcaaatatctcctccagcttttacaaggcagagatggagttggtcatttaacatatgaaaggaattttcttctggggagttaagtaagtgatgtgaggaagtgatgagcatccttttggcagctactgctccatggtgtctcttggccttcaaacacccaactttcccttttgcagaggtagcgttgcctagtggttcatagcagacactctgaagtgagaaagacccgaaactgagtctaccatgagaataagtgtttttattaccttataaacactaaaatatttcccatctcagggactttgcgcactctgctccctttggctggaatgacttttctccggctcttttcatatctgattcttcacccttcagctttcagtagaaacatcacttctgcaaagaggcaagaggtgtgttccttccatccttcacgttttccatctcagtaccccatatctgcccttcacaggagccataatatagtgcaattattttatgtatttgattccttactcatttttgtttaaattccctatgagattataaccccaggggtcatgctctgttgttttcactggtgtatcccctgtggggtttggcactgaacactaggtaaattcttcagatgaatggatgaatgcaattgtgactgctgtccactaacaatgtgaccttgaaaaaggcacttgactttcctaagcctcaatgttcttacatctcaaaggaggataatatcgcctacctcacagctacttggaaaactggacatggaatgcaccactgttctactgcatcggttccaaaatgcacatcttttgcactttaacttttttgaaataaagatcttataatagctagactcttcagtcaaataaaatatgttaacatctcactcttatacaggacccaagttcttctaactttttaaaaacttcctttggaaagacatggttgtgtggttggatgtgtgtatttactgtttaaggaccaagtttacaccagtactcgtgcgttctgctccacaatttcaacacgtcctccctctcactccccgcctagagattgctccttctgcactctcttaatgagactgtcgttgtacatttttaaaaattttattctcaaaagccccagggagttggaataatgaaacatacttaattaagctatgcaaagcaatcctgccatctaggtggcattttttgttctattttccttggttattccgagaattatattattatataagagccagcattcatagatcacttactgtgggccaggtactgagctaaatgttttacatgctttatttaattctcacaaactcccccactgtgagtggggaccagcattatttctattttactgatgacaaaaatgaagctcagatatatttagttgcttgctcaaagtctcacagctaataagtggcagaaaaagctgaaatttgattccaaagcctgtggatgtactgcagtatctccctatccacagggaatatgttccaagatccccagtggatgcctgaaactgcagatagtacagaactgtgtatgtatcatgtttcttcttacacagacatacatacctatgataaagttcatgaattaggcactgtaggagattaacaacaattattaataaaatagaacaattataacaatatgctagaataaatgatatataaatgtggtctctctcttaaaatactgtattgtatataatattttcagactatgggtaactggaatcacagaaagaaaaaccaaggataagaggggactactgtataggttcgagtcattcaaaagcgactaacatatacgaagcacaaattatgtccattgagaagttttctgtctgaaattaaagtccaaagtatcttgtgcaaaagtgtttctcaaattcttacttaaaatgtcactttgttaacattcagctttgttaaatgtaaccatgtaaattaaagggtataatacatcaactaattaacataatattatacattcactgtaaattatgcaaccaaagttcttttggttgcaatgaaaaaaaaaaaaactaacttaaacaaaattaaaccactacgggcgtttagtggttaatgtctgaaattggagcggcgcggtggctcatgcctgtaatcccagcgttttgggaagccaaaacgggcagattacttgtggtcaggagtttgaaactatcctgaccaacatgatgaaacctggtctctactaaaaatacaaaagttagccaggcgtggtggtgtgcgcctgtaatcccagctcctcaggaggccgaggcaggagaattgcttgaacccgggaggcggaggttgcagtgagcctggatcacgcccctgcactccagcctgagtgacacagtgagactccatctcaaaaaaatacatatatatctctctgaaaagatcagcgatagggtagatttcagataaagtcagatcatggctctgactcattcttcataccatgcttctcttagttcttcctcatgtataaattgcctttatcatcagcctggtttatttcatggtggaaaaatggcagcagaaattccaagtctcacatttacacacttgccatatatcatatagctcagaaatttttaatattagaccaaattagatagtgtgcccattcctgaaccaagcactgtagtgagatgcatgggattattctgattagctgtggtcaaataggacccaccaaggcctgcatggtaaggagaagagaaatggaatctggaaaggcaagtacattttgtaccaccctaggaaaagctggtgtctaacaggagatgaattgtcacagggaaaagaaaaagtgaatgaggctccagatacaacttgggcaagctcagaggtcactgcagtaccttacttccccgctaaaactctccaaagacttttcataatacttgaaacaaaattccaaactctcatcgtggtctctgaggacctagagaacttggctcctctctccaaatgcatgctcctctggctcctgccgttctgaccatcatgctgctcctcagaccctccaagcaatttcccagttccaggtctttgcccttggcagtccccaatccaaaacgctctttcctcagactgtcatattactttctcattcacttcatccaggtatctgccaaatttcaccttcccaaccattctgtctaaaataaccatccttcagtctccatccctttactctctgctccgtttctcttcccatcccatatcaatagcaaattgacattgcctgtattcatttattttctctcttctcactagaataggagctttgagcagcatgcttttttctgttttgtgcgtgactgtgtgtgtctcatacttactataaggtctcacccatagcaagtgcacaatagctgactgttgagggtaaatggatacatgaaaagacaaatgaatgaaaacgggtgaatgcatgaatgaatgaacgaatgaaagaattccaggaaattgctaggtgaacatgggtaacagatgccaggggactgtttttattctgtgtgttttgttttgttttgctttcacctcatcggctgaagacaaacaccctctcccagtcctgcattcagagttctaagaaatgctctcttttgaaagatttattaaagtcaagataaaatttaaactcaagtaaatagctaagaagtatgatggatccctcctcctgctgtcatcttttacactgaatggaaaatatttaccagtgtcttggcctccctgcatatatgtgaattgaatttttttttttttttcagatggagtcttgcttgctctgtcaccaagctggagtgcagtgacaagatctcggctcactgcaacctcgcctcccaggttcaaacgattcccctgcctcagcctcctgccgtagctgggactacaggtgcacgccaccactcccggctaatttttttgtattttagtagatggggtttcaccatgttggccagaaagctgacctcgtgatccccctgcctcggcctcccaaacttttaaaatccaggcagacaagcccattatagactggtttgcacccagtatcacaattaaatcttggtttccttctttctttctaccttttatttccttccttctgcctagtcagaattactaagattcccttgctggggattttgctcaatcctctgtagagttaatatgtatgggtcctcctcaggggtgcacgatgtctcaagggactcattccagaactaatttagagggagttgatggttctgcatttgagcttttgacgattcttataaacattttcccaggaaagactagcttctcccctttattcttctgcctgttttattattggcaatgccaaacatagatccctgtgctaatgacaataataataattagtattgatgacaacattaacattttcagaaaggttttgtagtttataaaattaatttccatcagtcacactttcatgatgaattaactctaaagacaagcaaatgtctcctacccacaagggagagatctttgtaccagcttcgcagcattggaagacgtcctcggaccgcatgaaaacacaactgaccccttttctttcccctgagaagccagagaatcagaagatcgggtgctaaagccagagaggtcatcttgatactgatcctaccactaactgagcctcggaaggtcattcttctctctgaaatctttttctcatgtgaaaatagaaataacactactacttatttcacagagatgttgtgacaataatataagatggtgcatgtgaaaatccttaacataccacctagatcagaataagtgctgtggtagcaattatcattattgacttattcaatatatatttattaagtgtctacactatgctgggtgctggtgcacaaaagtaaaatggacaaggttcctggaattcatcatcatcttcatcaatcatgatcaccttattattaataaccacaaagaacctagaaggtgtagtggaagcaatgcacctaggtgtgggagaaagaaaaactgtgcttctgtcatgcctttgccatgagccagacagcaaaacattaaccctgtctctttggggcctcaatttcctcatctgtaacataacacagagaagtaatttattttgattttgtaaaaccagttgaaaatacgttgttacaactaataatatattttatcattttgaggcaaattttataaattattaaaaacataaaaaagagaaattagactttgatctaatttaaagcagactcattatcatcactcatttgccgtctaatctttcttaagtggaagaaaagggttggagctaccacttacatcctagggagtgtgatgatattgcaaaagcacccagaagcctgctttgtacaaaggagaaaaataattacaagttaatggcctaagtgatctccagcatccctgcctgctctgacatcatgaaatacaattccagattattgtaaccaacaccatcaatctgcagatttaaaaaaaaaaaaggagaatcagaaaagttaagaatcttaacaaagattacaaccatatgcaggagcaagctaggattaaaacccaatgtcttaaatcttagtttgggtcctatttccactacctcataaaaactcggatgaaggcagggaatgtggcttgcctgagaattacatccacgcccatctggacccagttttctattatttttattaggaaacacattcttcatgccctcatacccacaaacctctctgtagacatcaattcctgactgttctgagcagcaactaaccaagcaaagagccaaatgtccctgtgacttggttaactgaagatggaccgcatgcctgagtgaagaacagtttcccaaagaggcttggatttctgccaagggacaacttgagtaaagagtcgtttttatttattcttttacccataggttatttagaagtttgttatttagtgtgcaaacatttggggaatttctggagatctttcagttattagattctaattaatttcaaagtggtcacagaaatactttgtgttagtgaatccttttaaatatactaaaacttgttttatggcctagaatatgatatatcctcataaattttctgtatacatttgaaaaatgtgtgttctgttgttgggtggagtgttccacaagcaaatattaggtcaacttggttgtgacattgttaaaatcatctgtatctttactaactttgctcgttctagcaattattaagagtattgaaatctcctactataattatgaatttatttccccttgcagttgcatcagttttgcttcattattttgaagctatactagatgcatagtttgatctttttgatgaattgactcatttatcataatgaaatggcaatatttaatgccaaaaatcttcatgatctgaaatctacttagtgtcttattaatacagccagtccagttttttaaaattagtattagtgtgtacatatttttccatatttcaactttcaacctatttatgcttttatatttaaagtgggtttcttatgggcaccttagagttggttcttgctttgtgatgtttatactatttacatgtaatgtgattattaatacagtaggtttaaacctatcatcttgctatttgttctatctaatctttgttctctttttcctttctacttaccttcttttgataagttgaatattttttatcattctgttttatttcctttgtggcttattagccagagcattggggtttttttaatgttagtggtttgtttagagtttatagtatatattttaaatttatcatggttatcttcaagtgatgttataccactatactacgtaagtataccataagaccttcaaatagtatactttgatttccctgctaatctttgtgctattgttgtcatatttacttttaacaacctattaacctcatgctacattgttagtatttttgttttaaaagtaatttatcttttaaaatgatttcattgtttaaaaatcctcatgtgaggctgggcatggtggctcacgtctgtaatcccagcactttgggaggccaaggtgggtggatcacttgaggccaggagttcgagaccagcctggccaacatggtgagacctcatctctactaaaaatacaaaaattagccgggcttggtggcatgtgcctgtaatcccagctactcaggaggctgaggcaggagaaggtggaggttgtagtgagccgagattgcaccactgcactccagcctgggcagcagagtgagacttggtctcaaaaaaaaaaaaaaaaaaaaaaaaaaaaacaaaaacctcatgcgtttaacaatctagtttttgtttaattgcttttcattcttttgtgatgatccatattctgtttggtattactttctttctccctgaagaacttcatttaatatttttttgtaatgcagatctgctgctaattcttccagttattctattctaaaaagtatttcattttcactgtggaaagatattattactgtgcaaagaattctaagtttacattgttttctttcagtacaaaatatctttctgcattcttttctaacctgtattgtttccgacgagaagtcggctgacatcttttttcactctgacagctttcaactgtggtatatctttttagctgatatatctttaaaactgattttgagaaatttgattatgctatgtcttcatatttctcattctcaggatttaagttttttgaactgagggtttatagttttcattaaatttgaaaatttttcattccattatttttccaaaattcttcctgcccccttttacttcagggattcaaattaaacatatattaaaatcctcagtcgtgctcaatgcatagttcaattgtgttttctctaagagtttcatttggggaaattactttgttttcaagttcactgatttttttcttcttcaatgtcaaacctgccattaatccatccagtgtagtttttatctcatgcattgtagattttatatctagtagtttgatatggttctttaaaaaacattctctatgtctccacttgaatttttgaacctatgaagttgagagttagagttactctctatagtaatagccccatgtgccaattccaacattcatttaaatctgggtaagttgttacatgatattttttcattatggattatatttccctgctgctttgcatgcctggtaacttttgatgggatggaagaaattataaattttaacttttttcgtgctgatatttttgtattactataaatatcactgagctctgttctagagtgactaagttacttggaaacagtttgatcttttcaaattttgcttttgatatttgttaggcagagtgagagcaattcatagtctacagctaattatttctccattattgagacaacccccttctgtgtactcaactcagtgcccatgaataactgggttttctagtctgactagcggctaaccctcactccacgtgagtcctgggctctgttattttcaatctttgggaggcttctttctttggctttaggtagtgtcctcacccttatgttgagcagtattcagctcaacactaaggtgggccttaggcagatctccatttacgcggatcacttttctcaggtactctctcctatgaaatccagctgcttttgtttcctagattcaactttgtctctgccattcagggagtctgccacacttgaatcccctatccttaagttgcagcctggaaactctctcaaggtggtgagtggagccataaataaaatgtggtaaactcacttattttagtttctatcttcttttccccaatattcagggtcttaaaaacaatcatttcaaattttttgtccattttggttgtttcagtctgtaggggatattacagtccatcttggtctgaagtagcagtcaatagaatggaattcattgaaggtaaataagaccattaaatctctcaaacatatctccaagtagttagaatttacaaaccccaaatttatttttaaagcaaatattgaaacccccagtatgactaagaaaaagaaagcagattggaaccaaatactttactacgttaaatgacacattggaaattttcaagacaatttcttaagcaagtaatacgggttccatccggctccatcatttgccattcacttgacaaatgtcataacgccactgcacaccccaccagagcaaatattttcttccaaccttaaaataacatctacaaattaattcagtctgtcaaggggaactctccttgggtaattcaggaagtttttgcctttgggtaaggcactctaggcacaaacaactcaaattctcacctgtaagttgaaccaagaaggaggtttatgatctacagctacatgaaatgatcacttagtcgcagatgactatgtaccagacacacccagctgtaattttgaaagccaagttcattttactttgttttgagaaaatgtgggcaaaagattagaggcgcctctccaatcttgggaagcctctagtcatggaaaatcatatcccagcagtgctttatatgatttcacctgcagctttaagtaagaatgtttgaccagtaatgctgtaagcatataggataagagagacctatgttgtacacacttccagttgtgctaactcaggtatgaagatctctggaggtgagctatcaaaactccctgttattgctcattctaatatctgccaatcttaataatcatcaagttcttgttttggaaataaatacacataatgatgattatgataaaaataataaaaatgagtacaagacaacctgggataaaatactttaaaaagccctggaggtaacatggataaataaaccaacccaggtggggactaaggtgtactgcgcagagatgacagtcacttccagcttccagttgatcattagcaggtcaggatatgggattattatcactaactccatctttttcatggtaaacaaaaaatataatttttgtgaaatctgatgatagtgtttaaacattgggactttacttttggaaacaggaaaaacactctaagtttaaaaaaaaaaaacatgcacacaacacaggtcaatttgcagcctctgaaagtcgtaacgtggggtttggaaccaaaggaaactggatttaacttctggctccattttacattacctgtgtggctcttttcaagttctataacttctctagtcctgtttacttatctgtaatatgaatcatgatttttaattgacctgctggtactctagcattcatttacctctttctcattgttaacagaactcaaattttattgagacttcatgcctcctgtaagaatctatggaactcaagggaagtttaccccattcccagctccaggagtaggtctggtttgatttaacctatttgccttctctgtgactgggtcaggagtttggagttaagccagtcagtacctggcattttcaaaatcaccattattggcccaagatgggtacatgacctaatttggccacaaagaagtcttcccaggtgttaccagcaaacttgaggtaacgaggaagtcagttagagaaaaaaaatcacactgcccaaaaagcagagtcaagagatcatagagaaaagaactagaagcttgattatattgcacctgaagtccaaacttcttctggaatttttgttacgggaactaattcaatcacataactttgagttaacttgattgctacctgcagtaaaaacatcctaactcacatctaaggatgaaagataatatatttaaacagattgacacataggaggaagtcaatacatggtaggtcttacccttagagtactttcacgtttaaaaatatatatgcttagataatataacctatgaaacttgaagtttccccactcaccctcacatacataatgatgcgttgattaaattaaattgtttaaacttcctcttattaatagtgatggaaatgaaaaggaaatgagcacatttctcaggagagctattttctatcacatggaaaactgggcagtgtggatttactctttgtgtttggccaggacttaaccaaatgaagcagatcctcaggaagctgactgtggggatttggacaatggtacaccagacaccagcagatctgccagttcatttacccaactttgaggcccatgtagaaatgtggctggcctcccatgcccacgcagaacacagctagcaccatcacgctggaccgtgactcctccatccctaagattcatgccaggatttgaggcaccaggaacctggacgggggctcattcacacctgcaggcaggcagcatccacatggaagcaagaggtgagagaagcaaagaagcaaggagacaaaggcagagaacaggtggagaggcccgttctgcctctcttgctcccacctggaagggatgatcaggagagcttttggcctatatatagatagaggtgcatagacagatactctttcaggaaagcaaaccaacgatagctcataagttaatcggtcgtgagcacctgcccctttatactttgctgcatgcttctcccttttggtagaaaggatttttaactttgtctttttgtacaatatcagatgttgcccaaatcgtgtccagaatgaaacaaaaacagaggttttccccctgcctgaactatcactccctcatctctccagaccccaaaagctccatcgcctcctcatctctccagatccaaagttccatcactcgtcacttactcatctgtccagaccaaagctctatcacctcctcatctctccagactcaaagccccatcacctcctcatctgtccagatctaaagttccattaccttcttatctctccagacccaatgctccaccacccatcacctccctcatccgtcgagacccaaagcttcatcacttccttatctctccaaagccaaaacttgacttgccatactttctcaatgtactgattaaataaaactgccggtaggattaactctgcaaggatgcacccaacccagatatattcaccatagccatagattacacatttttggaaggcctactacgatgtctatcatggagcaaacactgtgcagacgcccaccaggcatcaaaacaaaatcaacattgggaacagagtctccatgtgggaagagcacctggaatttacagcgtaactctttctctccaacattctcctttcccttggaggattatttaccaattaatgttaaagttcctcatggtttaaacccaggccctcctgagtcatcattctcccctgcaagaccttgcccagtcgtagggctttgactgccatcaataagctcaaatcctgtgtattgcattttcggtttgtactcagactcttctctctgattgcctactgagatttccacttggatatctcaaaagtatgtctaatttaacatgtctaaaattggatgtccctgactctctgttccccaacatttctttcctcatttcttctgtttagtaaaagacaccaccatctactcagctatacaagaggaaaattattattatagctcttttaacacctcatattcatctgtcaagtcttgtcaattttatagcccaaatatgcattaagcctgcccacttctctctgaatccacagctattactgtaatgcaagtcaccacttcctctttcctagacctgtgctatgatctcccaaccagcctatgtttctacacattaaagcctcccagccccagtatacactctgttagcaggcatcagagtaatagagatggggcttaatttgctttgttttttcacaaaagagagtggcaacaaataattagcacatgtcaccaaattactaaatttcaaaatgaaaacttctctagtattcatccctggaggaaatagatcaatgtgcctttttgttcggcattctggttccaaaatcctaagacttacatctggcctaaggcaaatgtgaacaatatttgtgctttatgtgtgaccccaaaacaacccaaaccacctttccctcaaggtaaaggcacggccaacttctggtcctcccaagctgccagcatcaggtttctaccatttgtcgagctattcattgggtgccaattggaaatgattgacttgcattgcagggctggcatacggttcttttgacttccagccataaaagggagggctgtgttccaggagagatgccacaaacagagatgatgctgaagagaggctgttgacttagtgctcaggctgaacacccagcaagctcagcccactctcatgggtccatcaggcctagatcaagctgtgcctctagtccaggagaggaggagaattaacacctgtagagtgccgactatatcctagatgcttgactaagcacaatacctgcatttaagtggtatcatcctccctattcttggaattttctctgtttacaatcaaggaaatggaggctcaaagaagttaaggaactctcccagaataacccagataataagagggtttgaacacagcactgtctaagtctacattccacaaagtcacatagctttgggaaaaatgatttgtgttcctctggattctctcacctcgtatctcttgctgatttactttgagactcagctgtttttcccacttctgagttcagagtcccaatcagatgtacagcaaaggcccacaggacagcttggcctctgaggtgcctgatttcactgcgagaagtgtttgttgagcatatggtgatctcccagataaatatttgcaaagagttaatcacattcacctagggaagttttaactctggtcaagctcagagaattaactgagcaggcatttctattggcattacaaaaaaccaacagtgatcattctgattactaaataaaaatatgtcaaccaggtttagcacagtctcttaatgggtcattaaaccaagaatttttcctatgttattttagaaatgaagatttaaagtagtatcaatgtaacttagacatgaataaaactctttctcacatatatatcttccttctatttccctttctgcaggggtaataatttacaatgttgttggtttttaaagctgaagcctgacttcataactcaagaagtcaatccaaaacacataaatggtcatgccaggtgtcatcaatgaaggccaaataacttcccttcaatactaattcataactctcctgggataagactttttttgccccctcatttgtgctatagatctacttgagctcttctacttgatttccagtgcagtaacttctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgacctgatagttatttgtaaaatgccttctccatgcctggcaccatgctaaatgtatatactttaagatgttacaagaagaagagatgtctatcttacacacgcaccctctttaggaaaactcctgggttcacagttgttaataacttatacttggtaaatatgtggtaaattcatagtcaagtctgtcatactacctagaccatgaagttttcttgatgccacactgccctcttcccaatggccatatttctcccaaggtaatcctttggtaagagggttttggtctgaaaaacatccaccctctcccttctatgacctcctcttcagtaagtgtaaaatgtgtcccctccgctgtggaataagaaacacatatatgcatgcagagagaaagacacacacacacgcacacaaaaatgcaggtaaacgtgtgcacatgtgtgtatatacatacccatgtacatatatgtgtgcaaaaacacctgtagacattcacaaacacacagcactcacagcacaaacttaatgctttgcatttcataaaaccacaggctaaaatgtgatatgaatttcacctgggtctatatgcttgaaccaagccccaaataggcattagtggctagagctttaagcaccagaggaaataaataaaagctaccaaaaagcagcttggaaaataatcacagagcattgagtcacccagatcctactcctcttgttaggtgctgtgctttagcataaggacatttttctttctcctatacctccaacttgggaggctgggcctctactatggaatattccactggcccccaaacctcagagcaaacaatagatgaatgacagccctgccccgcctgataatcacatgatggcctttttgtgtctctccaactatgaataattggtgcttagcttatgtaagacaccaaagacattttttgaatgaacaaatggtaatatcatgggctatggcatgaagagacacttacttcactcataactttatttcatttttattttattttattttttttgagagactgggtcttgctctgtcgcccaggctggaatgcagtgacgtgatctcagctcactgcaacctccacctcccaggttcaagtgattctcctgcctcagcttcccaagtagctgggactacaggcgtgcaccaccacacccagctaaagtttgtattttttttttttagtagagatagggttttaccatgtgttggccaggctggtcgaactcctgacctcaagtgatctgcctgcctcagcctcccaaagtgctgggattacaagtatgagccaccacgcccggcctaataactttagatctacaagtttcatccatagtagtaaccatttacagactgcttttccatacgccacacactggtctaagatgcaaatgcttttcttgtccccatattacacctgagggagccgacgtggagttcagtgactcacccaaggtccgaagtctaaaaaagtacagattaggttcgaacccatgcaacctggccccagtgcccatgctcttaaccgtgatgccactgcctcccagggggccctggccactcctgaactggacagattcttgtgatggaaccggacacaacagccgggattccaccagccaaacaggtcatggtttaccttcacaattttgggagttaacagtgacatggtctgtgcttggtgaaggaacagatgtttaataactgtgcagtagcaaggaggttatataacatggctgagctatttttaaactttggaaaatgctgactgctcttttcaaagtgtcttctgtaaaatcaggaatattaaacatgaagaaaatgtccccctttcctgtacttttttttgcctgaaactctatgtacagaaacggttgggtgtaaggtcatgaacataccttcccttgcaagcagcccctggtaccacgcccagcccatgagcaacaatatcctaactgcaccagctctttgcctgagattataaataaagtccatgaggaccaccaagtggcatgtctagctggccccatgactttgttctcaaccagtcaaatctggatcccagatcccctcagtaactcaccacgaagatatcaggtatgacctcatctgaacttcttctggagctatttgcaacctccctgctacataggaggaatagtgagagctatttgtttatcagatgctttgcagagtaagaccttaatccagctgcaaatgtaatttttaagcttgaagtgaagaactcctaactccagagtcctgggcttctattgaacaagctggtagatctaacacaggctacagataggtctgttctctgctttcagctatccagactgaaaaatatcttactataaaaaaacctaaatgtccatcaaagaggaattatgtaagtgtaaagatggaacacttatacaacagaatatcatcaataaaataaatgcaattgaattatcttcatagagggattttgaaaacataaggttgaggtaaaggaagttctaacacattagacaccatttttgtacgttagacagaagtatgcattgggaatacggttgcacatgtatgtgtattgaaagtacgaacacatgtacatggatttggatgtaaaccaaactgattatcatgttttcccttctatggagagaacaggagaaaactgggacagggaaacagatagaatcagaacttctacattatcattaatgttttattgctttcaaaatgttgaaacaaacattaacctttggcaggtttagctttgttccctatgatgaatatcgggttgagtattttatcagattctgttgttttctgtactattcttttttcaatattaaaaaaagaattcttattcctaagtttgtctttagataaatttcccccaccttgatcagactgtatggtgtttgaggagagaaattatatcttaattcatctatgtatcccaggggctagcacagagtctgttggttggaagcaatgatagacagaggatagaatatagtgccttgaccaggtgtggtggctcatgcctgtaatcccagcactttgggaggccaaggcgggtggatcacctgaggtcaccagtttgagaccagcctagacaacatggtgaaacctcgtctctactaaaaatacaaaaattagccaaatgtggtagtgcgcacctgtagtcccagttacttaggagggtggggcgggagaattgcttaatccaggaggcagaggttgtagtgagccgagattgtgccacagcactccagtctgggagacagagcgagactctgtctaaaaaaaaaaaaaaaaaaaaaaaaaaaggagatataatcctttttgtttttttgtttttaaatgctttctttggcctttctctagctccctgtcaagggcagcctggcaggtttccactattccctggggtgggcgtcagggaccgtgggagagtgtgggaaggagagactgcttgtgccttatccaaacttacacactgggtggacaccaccagccctgcatggatggagagatgtttcattaaacaccaagcagtggatggcgacttaccacgcttgatgcattgcttctctggggctgaaataccatttacaaaattactgtgtttaaaggcgtaactttgggaaattgcgcaacagcatttcacagcagcagaattttttaaaaaaagcatagaatccagggtggtcactggaaagggatctaaatgtcttgccaattatccttctagaattccttttcctgtatatgttatatttcaattgccctaaaattgatttatgtttccatcaaaattatatgtttctgaatattccagctgcagggcacatattatgatggaagtgagaattcattagcctcgtttgtgtctttgggctggcagcaatcctgcctctgtaagagactcccatgtctcatgctgatttatctgagttccttcctgatatctggacaattatttaaaatgctgaaagtggcagtgtagaaacaggattactaaagagagtaaaaggacagaggacggagaaatgtcaaaggagcatgatttcttaattcaaggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggtaataaaccaacatggtttgttgactgtatttcccttttattattattatttttttgagatggaatctcactctgtcacccaggctgaagtgcagtggtgcgatctcagctcactgcaacctctgcctctccctcttgggttcaagtgattctcctgcctcagcctcatgagtagctgggatcacaggcatgctctaccacacctggctaacatttgtatttttagtatagacagggtttcaccatgttgaccaggctggtctcaaactcctggcctccagcgatccacccacctcggcctcccaaagtgctaggattacaggcatgagctaccacacccagcctgctgactgtaatttctgatgaccaaaaacttcactgatcactctggaagttatttagtattactatgtggtaaataccgtgctaaacagtacttttcatgcggcacctcaatgaatatgacaatctctagaacattggtcctcaaagcacagcccctagaccaagaacatcaacatcacccaaaaacttgaaagaaattgcaaattctctgggctcaccccatattttctattacattagaaactctgagattgaggcccagtaatttgtgtcttaacaagtcctcccagagattctgatgcctgctgaggcttgagaaccactgcctagaaattaggtgctattatcatcactttgcaataaacacctgaggcccagaaaagtaaaatgatgtgcaagtcatacagaaagtggacgagacaagctttgaacccagacaagtctaactccagagttgaggcccttaatcacagttctacactgctcattatctgaggaataaagcgtggattaaatcagtgaacatcaggcaaaaccatgcaaaattgggataggagtgatcattctaaatctcaacagctgaaccataatgatgggccacaaggaacaatgacacttctcagaaacctaaaatttaacttaaatgttcgccaagatgggagtagctaaataaattatgatacattcacataatggaatataatgcggttctgtgagtaatgtttgccaagatttccaatggcctacaaaaatacttagaatataagaagggaaaaaatcaaatgcaaaatcaaacagagaccaggagcactagtgtgggaagtttccccaaagcgtaacatgttggtgaggatgtgggaaactgggtagtttcacaaactgttgttgtgactataaattggtgttgttactttgcaggacaatctggcaatagatgcttccatttaaaaatgcacatgaattaggacccaaaaatcctatatcttagaatcaaccctagaaaaaacacttgcacatgtgcttagacatgtataaagattatcacagctgtttagcttctaataggaagcttcaaaatccctaaattaaatgtttataagacaaatgatgaattcttgaggtgatgaaaaccccatttaccctgatgtgattatcaaacattgtatgcctgtaccaaaatacttcacttatcccataaataaacacatttttgtattgggggttggggcgggaggtggggatgatcaatagggtaaaaaaaaacatagaaagaatgaataagacctactatacgatagcataatagggtgactatagtcaataataaatgacttgtgtattttaacataaagaatataattgaattgtttgtaactgaaagaataaatgcttaggggatggataccccattctccatgacgtgcttatttcacactgcacgcctgtgtcaaaacatctcatgtaccccataaatatatatacctactatgtacccacaaaatttttttaaataaaagaaaattaactcgtaaattcctaccattatgcagactggataactaaatcatgataccatgatatcatagtgaagaatgtgatgagggctatgaggttagacttatctgggttcaaatctttatgagttacaaaaaatatagatacacttgagatacagccatagacagacagacagatcgatcaatcccaggtgtaggtttccaagatatattgttgagtagaaaaaaaagttaagttgcaggaaacaaagtctaatgtgacttttcttacaaaggagatgaaagaaagagagaggagagcaaaataaaagtcccgtaagtaaacacataacattctgcattttcagtgcgtatttccaacaatgagtatgtaagcaagcaaacaatgacaacagcaaaactctgatcccactttgggagacaacaagccctttcttacgggtgcaaggtgtgcatcgggacctctggcctctccatctgcccgtagcagctggccttggcctcggggatgtaggagaacttctccagcatagaagatgcagcggtggttaggatgccaatgccgtccctcactctcgcctccaggctgtagtcccagtcatcgtaggagacagaaatgagtcccgatggaaactcttttgggatgagctccgtgttcccagagaccaagctggggacaatccagaagaaatcatacccggtgaggccaagggagcgggcctcactcagaatgagaacagcctcgtctttggaacagtagagcaagatgacagaagagtggatcttcttcagctggacttgtgtctttgcatcctcaaaggaagtgtccagtgtgatcacattctgcatgtcccagcccacaaagctgttgtccactgtggtcttgacgaagctgatgaattccctgtagccagggaagatagtggtcaccagggagaagacatgccagtcataatcctgcatgatcttcagcatgaccgtggcttgctgctggatggacgctccaaactggaagaaggtagacgtcggatcctgccagtgaaaagaaagtaaaacagaggatgaggcaggaggtggtttatatagaagcacaaactgcgtcctagaagtaaggaaagtaaatcacacatcaatcatttgcagacattcctgagcatctactatatcccagactccagaacagatcctgcaaatacagagaggacagaagcccctgtactcaggagctcatagccaggtcctggaaggatgtctgtaattattgcttgcttatcatctattcttctcattttcctctagttcgtcctgccccttcctcctttgagtctatatggttctaacagaacaaactctatctgacccccaccccagctcatgaccggaaaatcaagccacggaaataaaacagcatcagcaaagacagttttctaacgatatatttggagcccctagagtctgccaagtatgaagccatttctcctggacccctttgttatacaagccagtgagtttctatgttcatttaaggagtttgagtagggtttctgtcacttgaacatacggctcccacataatacagagtatcataaataccatgtggacatctaccttttcaatcaacaaatatttatcgaacaccttattaagtgttcttaataagaattaagtggaagacaacttctacaaactaagagctaaaagaggtatatgaagtgctgaaggagaatccaggtgaggaagaggagaagtgcatggatgttacagtcagaggaatcccgaggatgcactgcgactatctcagaagctgtagatgaatgcatcatggcaccgaaaggaggcggacgatacgatgttgaagagcttggcagaaatccaagcacatagggcctattcagagcataagggagagtcactgaatgctctcaccctagaaagtggcatggtaacttatgtcaggttaaagggcctctattagccctaacatctccacccatctacgattgtgagaacaaatttccatttagaaaaggcaggtgatgcatacagtggtacaatatacaaactgccttcataccccctaactcatcaaatccccataatgatcctacaaagttggtattgctggcagggaaaacgaggctcaaaacagtcacagagcaagtagacatctgtacctcagtgccatgactctgcatcctgccccctttctgacactcaatcacagtcttcctgggatcactgaagatctgtatggaacagatgcttaaaccacgttgttgacttgtggacatggtgcaaaaatgccaactaaacagaaggtatgcctctgtgttagagcaaaacaggatttgagaagtgctgagatgtatttctttcagggaactgaaagaattatcaaaaggtcctcatcatattacagccatgtttttattttgcgttctgtatttaccatgagtattgaacacaacctcaacaagataacttatggggattccactgagagagagagagagagagagagaaagagagagagagagagagagtgtgtgtgtgtgtgtgtgtgtgtgaaaggtggatgttccattcatgtttttcagaacaatactttgtagctgtgcatgtcaattccttcaacaagtttacatcactttccctgtgggtgctcactaaaagttctatcagaatgggccaaaagctatagttcttcgaaatactgctcttttctgaaatgcatgggtttgggggataatttgagtgaagcatggcctgaaggcagagaagaaacaagaataaatgtcttctgggccccttccaacattgcagttccatgaattttacctaattaaattaattaaagtgggtaatagatttaaagactttggataattattgttttccctacagtagcttttgcagaaatctaatattcttgaattgattaaccattttaaatcacatctcaacaagactgtgagctcctcaagggcagagatttttgttgttttcatctttatgtccccagaacctggcagaagtcttggcacacccataagtggatgacaagggaatgaagatgtgaatgaagcctaaaggactgtccttggttaagaccagaaatggaaagaatgggaattcagtatctgagattgtattttgtgtggattctgaatattgtgtccaaaacaaaacaaaacaaaaccttcaagatcatcacctacaccttcctaccctgaggaactacccaaccatccaatacccaacctatatctcaatgtatcctttattgataaagaggagaatatagaagacctataaacctcagcagttgtccacagaacttcattaatgccaaaatagggcaacaagataaaaaaaaccaccaacagaagacaacacagaagtagagtctaaaggcaattatattcgccaacctcacacactgtgagacgcctcttgggatggggcaaaaatgttctaaattacaaaagaaatgtgatagctcccatgtaaatgatgcctcaaaggaagccagtcaccagagttaccttctgactgcaaaaggtggtggatcagcatcttgcactaagtacacaaggaatacagaaagctctcaacaagacacacgctaaaggcaccattggaacctaataaaaagggtctatgagacacttccttgggaagattggtactggtggagaggtggaggtcagacatgccagatggtgatggaatgtgggatcctccaacacccttgctctatgtactctgagctagacatgaccagggtacccatgaaaaggtctgtgcacagagcaaagctgtaagcacacgcatcttatctggttctctacatgtagagaggaaggcatggctgcactgtgaacttcctcaggagaaagataattggagggacagcagttaattggcccagagccagctcggcacaggccatctgtgaaagagtaggtgcaaaaacccttgctttgtgctgtctccaccccctgtcatgccaaacttcagcccaagctgaatctctcccattacccactatgctgatccccattcgcagcctctctgcagaaaatggagaatactagaacctctggggttggactacccagctccaatcctcattatgtggccttggatgggggggaaaaaaaacactcagcctttctaagtctcagttttctcatctataaaatgggtgtggctatggtaataatgatcatagtaaacatgctagaaatacttactctatgagagtcacgttgctcctcactttctaggtgctatctcatttaatgccacccccaaccaccttattaagttggcactaatagtatgcccattttacaaatgaaaaaagacccagaagtagggtgatttttccaggttcgtacaggtagaaaatcaggtttgcctgccctcagggtctcgagtttttacctctgcactctgctgttgccaataatggtgcttcctcattaagttgtaggaattaaatgattctcttgtatcaaaacacccagtgtagtgcccatcaagtatgaagtattcagcaaatatttcacatcaggagatcatgctatcttttgcaagaggtaatccacactctggacttggagcatctcaacaactcaccctgttcagagctgcctggttgaaactcttaaagcacccctttaaccatgccactgccctgctctatagtcatcaatagctcccataggcctaccatgttaagttcagactccctagcctacccatctatgtgcaccagctttatagttgaaataccatgagctctagggtctattgaacctaaattcaagtcctgcctctgagggactgtggctaacctagccagccccgtggctttgaaaaagtgcttaatctttctgggcctgagtttctttacctataagataggaataatgacccttccatcacatgggtctgctgtgagaatgggatgaaaaggtagaagtgggagactcatctgtccacgcctgactttgacagtttgggtgcttgtctccacatcctcggtcctacagaccacacagacatcgtcagaaacctaagagggtcctcatcctatttcaagaactggcctctccaggtccactgacatgctggtttcaaatccccaccaccccatgcaaaccagctcattcattctgagcccaaggagcctgtataatgcaaagaagaaactgcctttccatacagcaatgaatccatgctttggagagaaaccatccctaatgtccttcctgggcatcatgcagttaccctgtactactgtcatttctattggtatcttaaaattcaacccaaaaaccaccatggaccaaaagcatcatctaccccttggagggacagaagcaagggcctatttgcaaaatataattgcatagcagagcaatgaagaggctcacatttaactttgggatttcctaaggtgattttatgaactggcaggacatgatggggaatctggccacactcccagggcctggcgtccaatatgccaaatagcccaaagcccctgaacatcctttccactccctgtcttgatggtagaggccacctctcctgcacttacctcctcctgccatggctcagcctgtatttttcggattctacatatcagcctctgaccacctctggcactcggcttccttagaatgtgcagctgggggagaggaacagatttcatacacccactttggttctgaagcaaaagcacttctctccccatgctcactgctctgcggaagacagaacaaactgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctcggtccccagggtgacacctgactccatgggtaccaaagcctggtgtttcctagagcataatagcaacttacattccatttacccattcataaaggttacaaagcccatccacacccattatctctttgatcctaactactcaagagataacgcaagtggcataacactcatggatggcatttctcctaaagacacaggatgagaggttaaatgacttccctgagatctacatggccccatggtgatggcagctcagtcatcgtgagatgcatccagttttcccttgctcacatcagtggctctcattcctggctgcacatatgaatcccttgaagagttatcaaagaataacctatgcattgtgccccatgcaagtctgattgaaagggaatctctgtggcctgagtatctgaactttaaagctgatttattagtttttcctctgtctcttctcaacagcagtatggttgagaagtaggtattcaagttagtatctttaaagccaagtacaatgtctgacacacactaggggcctgataagtacttggggaaggatgagaggggcaggaggcttacacccaagaagcatgagagaattggtcactattgtcaaccccacacccatttccacaacttattttcctgctgtctgccaagaaaaggaaataatggaggtaactcagcaacgatccagagagactcctggggaatttgcattctcctgttgaggactgcccttgtgagccctggtaagccctgatgtgctttctgttactctcatagtgtatcaactgagcatttcaacatattttatttcaatttccaggggtgagaggaaaagtaaaaacatcaaataagcctggtaagcctgaggattcagatggatagcattctcacgtgcacataagctgaattggtcacactggaaaacaactactccaccaccacccacctccctcccccttcctctgtcatcatcatcctccatcatcatcacatccatcctcctcctcctcaccatcatcatcatgaccatcatcatagccaatatctctcttgggcatatccaatatgtagctctatatagcatacagtgggatgtcttattattatccctgcattaaagattttaatctggatcgtatgtggttgcctagttgcggagaggtgtgaatcttgcatgtccttcagactgacaattcttgagggtagggcaccgtgccctcctgacttctgctcagcaccttgcagactgctggaccacttctttgagaaggaaactggcacaagcatcccccctagagtgcaagactgcccgtgggcaggaaaggatcccatgctctatgtacttaagcagacctgccagacctaccactctagaaagagacattcatccgtggattgtctttcattcattcaacaaatttaacaaactccagctctgtaccaggcattgttccaggaaagtgaatctagggaaggaggctaccaaagtgaaggaccctgattccatgaattttacattcttaggggaggagacaaacaaagaaggacatcaataaatagaacaattggccgggtatggtggctcatgcctgtaatcccagcactttgggaggccaaggaagaaggatagcttgaggccaggagtttgaaaccagtctggccaaccccagagtaagacccatctcaaattttaaaaatttgaataaaacaaaatagaataatttcaaggaaatcaaatgatgtcatagttcaggagtggggtggagagaggagccccactctaggtcatctgatctgctacattggagctgatcaaaatgatatgaagaaggagtcatccaggcaaagattaggggcgagatgagagtagggagagccattccagcagaagacacatatgccaaggtaagcgagggttcgtcaagttcagggaacagaaggaaagtcagaacagctgaagtttaaggagcaagagagagtggtgagacatgagttaggacaggaagcaaaggccacatcacacaatgaatgccctgtagtcaggatagggagtctgtatctaattcctaggtcaactgtattgcaaacaactcctctgctaaatgtgccaccagtgtctcccaatagggaacctgggagaaacctggaatttgggggattttgtgtaagataaccctgttcttccctctggaattctgatctgtgccaataggtaagcctacattgactaacatagaagggctgtcatacatagaggggttgctgctgaactgaaggaagcagctttatttctggaataaaaaggagtctttcaggctttcccataacacttgctaggttatgacttgaaagatgcagccagcatctttcgtttgctatatcatttagtcaactggtactctaacttcaaatattgtggctagaacttccatgttttcctgggaatttcagaccttgtcccagtttaccacccagagccaagtttcccactatcaagtccacaatgccagaggaaagaacacataaatgcatggagaaatgtatttcttgattctcgttgcagctgatttaggacagcccaatatactgtacattaattaggaccacacaatgatcattgctcttgaactcagccctgctttctagatcattagcagggctggccaaaaggaggccctgctgagattcagacccttattgttatgcaaggaaacagcaaagacccaagctggctttacctggtgctctgtcaacatgcaggtgagcatctgactccacgcttccaaacagggtcattagcaattatggattgtctggggctaggtccagctaatctcacacagaaagcaagcctgattcccactaaagccagagggaaatcctactggaccagagaccatggggttgggtctctgaggagctgataaacttaagcacaaggaaacagctttattttgcaagtcccaactgtgactgggcccctggccttctctgtgcctctgaaactattttcttcagatcccttttttttcatgaagcatgggcctccctgagccacctggtggatattttttattctgaccactgagcatctgttcttcctttactggtaatagtgaattccccctgagagccctcattttcctctctctcagtcaagccaattggcccatagtgccagtaattaattcgggggtggaacatttcctaatctgatctaatcagagtggctttctggatttatgaagaaagggactaggaaaagacagcttcttttactgttagacttgaacttggatggatgttctaccagaatttctggcagccacccaaccactatataccatcctaagaagaaagctatcagacccaaagtttaagctgtaagatcgagagttaccaagttctgatatccatgttgaacaccttgttcaagccacacctgaagacaaattctcttgttgtcaattccatgtcccaattaattacctcattttgcttaagccaatttgattagcttttctgtcacttgcaatcaaagattactgatgccactttggctaggaaaaaaataatgtaacatgtttaactcatcttcctgaacttgaatcagaataattcaaactacagggtagtgcatctctcttcatcatccttcccttttcttaccattcttctctttttcttcatcattcttccctttttcctgggacacccacctctcttcacaaatctcacttttccctgcatgagctcttcatctttcctcattgttttttgtttttctctaatatgtgctgagattggtttcttctcaaagactctgacagccacaacagccaagaccaagacttaagacatgacaagttgccaccaataataatcgcttatcattaagctgttccagcaaagagaaaaagcaaaccagtcccgttcattaagttttcgtctccggctatcatacatagaggagctgctgctgaactgaaggaagcagctttatttctgcaataaaaaggagtgtcttgggctttcccataacacttgctaggggcaggccctggtggtaaacattatcgtcgaaatgtccatttcaaaaatatcccagtgttctcaaagaaatgtctccaaacagctctgaatgctcaagttccagaagaaattgcttcttctccctttgggagtctgtatgttcctgttatcaaaggcacagacactggtaccaaatagagggttcaaatttcagctctttctcttactggtgtctgggccttggacaaaatccttactagctctgaggctccattttctcatttttttttttaaatggagggaattttattccctaccttaaagaggttgttgtgattgggataatgcatgtattactctgagcacataccgagagctccattaatgagagctgtgattatggtggctgttgtaatcaagaaagaatcaaccacaatgacagcaacaaaacccaaaacactacaacccacaaacacagcactaatgcaaatacaaacagctcccctgtggcttttttccacgtcttctaaatgacacaactttgcagcaccatggcaaaggagctcttatcgcgtgccaagcactgaggtgaaagcaggttgacaacccatcccaatgttaaacctgaatgttccgctttgcaggaaccctttcagtcctggacaaatcaggacaatcagtcgatcacacagagatcttcaagtgcatttatttaatcctcacactaatgtttcagggaatatttctattcccattctacagttaaggaagttggggcttagagagaggcagttctcaaactccaatgagcataagaatcaccttggatcttgttaaaacacagcgggtgggggctggggcattgcaagcaagctcccgagtggcatcagttgctgctagtccatggaccaagctttcagtagcaaagttctagaggtcaagtcacatggcatgcccaatatcatgctgcaagcatctctcagagtgatggttctgacccaggggtcctggtgccaggtgacctctgtccatcccagggaggactaggcaatgacataagacagtgtctgatgtctaacattctcaccaccgtgtgtttccttcaggtatatcacaggtatgtcatgcctgtcagtccccatcgtcttatccagcaaaacactttcagttatgagtcagaacatactgcatgggagtaaaggaagaggggccaccctggggtgaaccgcctcactcctgggagagaactgaagccatccaggaacgagaagagcacagagagagaaggaagcaccggtcagtcctatggtgcccatggccatctgccaagcaaagaaaatgaccccagggtatgcatagccacccttctctgcatgccagcgctgcagctcacaaatgtacgcaagtggctgggtctccctgagcctccatttttttcatctataaaatggacctggcagttttctaattacctggaggggagctggggtatctgtaacagggtaatgagcaagagctccatgaactgaaaggtaggggactaatgtgggagctcactgaggaaataggaaacagctgccgcctcctctctcccctccacctccacggtgctcccagaacacactgtccaggtctctattgtcaatcgtcaccaggtattttaggtgtctatttaaatagctgtctccatgcaaccagattaatgctaattcatctgtacagtaatagcacacagcccagctcccagtacatggggagctgagaacacattcagtgaaggtataagtaagcaggtgaatggatggacagacgaatgcatggatggatggacggacggatgaatagattggatggatagatggatgaatggatggacagatggatggatggatggtcaaataggacaaatggatggacaggtggatggatgggtgggtggatgaatggatgggtgggcagatgaatggacagatgagtggatagatggatagggtagatggatggatgacggaagagaaaaatgaacagatggatggatggttgggaggatgaatgaatgaatgaatggatggatgaatggatagacggacagatggatggatgggtagacgggtgggtggatggatgaatggagagatgggataaacagatggacagatggatggacagatggatggatggacagataaatggatgggtggttggatggatggacggacagataaatggatggatgggtgggtgggtggatggatggatggatggacagatgaacagatggacggatgggtggatgtgacatgagttgtgggtataagagattgaagaaataaacgaacatccagtgagaaaggcagtggctgagttagtagcacagtgatgggttagagagggcagggtataagtgagagctggatgaacagggggtgtgaaatgagggggctcagaggtagaactgagtgtctgcagtgtgagaatccattgctacccaaactctcacaatctgaaggcaggaaagtaataaacaattctgaggagggttgggctggcattcttcactgtctgaacccttgttacttgctctctaggattcaggaaccaaacagattcaggcaaagtggattccttctctatcaaaacccaggaaaggaattgattccaaaaagagcccatgtccttgctgctgtcagagatgactgagggctcttgtgagcacagggacagactgtttccctcccctaatctctagcccactcccaagcccctttatgtgttctcctctcccagctacatatcctcacctaaagcttttcctaggtatctttagtcttgcaggtggtgtgagaggatccctagggagcccttggacctcatggttacttgaggccctagccaaggtagaaaaaagaaactaccaagggtctaggagggaggaggtcaccacccatcagatgtgggtacctggagacccacatcttattgctccttctaggtatccaaagctcccaggaagctttgcaagcatcattttcacccctctcactttgcagagccctacaacttgaataggctacaatgacagccttctctaatgaggctactaagcagatagcaaacaggacagctataattgctttgcaggagcagagtcccagccaaatcatgggagatggcttagtgcagtggaaggcgcaaggattttggaataagacacatctaggtccaaacctcagttcttccacaggctacccgtgttgccttgagaaactggctcaaccccttaagcctccgtgtcctaggctgtaaaacaggaaaagcaatttccaccaacttcatagatcagatgagctcatgtacagtagctgtttactgattatttattgcattccgatcatttcttccacattatctcattcagtctttaacgaaaccccatgaagaaggtagtattaatgtctaatgtcaaaactaattaatttaaattttactggattccaaaacccttgctcttcaccactgacaacgtgcacctccctccttatcggtgcttaacctgtgagctccctttcctttacctggtcattctcccatatattcagataccatctgaagatcaacccttccccagcacagtgcttcctccatcaccagcttcttcctctggaagcaatgcatccacagcagaagaatgcaccctgaactaatgccaggagatttagcaacctaatctgcactgttttcctggagcataatattctgctcgcaaatcactccccccactgaagctaacacaatacagagcatcctttaacttatgtaaataagcatcttatgggcatccgatttattcacctctcattgctttggagaccagcagaccaaatacagaatatcatctgcccctttaacagagcaacgctaaattctcatgggtgcatttgtgtttgtgtttgtgtatgtgcgcacaggcgtgcatgtcaaaaagctaatatctgtttgttctcttcagcaagtactaagctgggcagcctgtccaagacccacttgcagctcaaaagaagaggatgaactaatatgaccagagctcaccattacaattaaactctgagcacaaatggaattaggagcataaacaaggggtggaaaagggagagattttaacagaaaaaaatgatggtttgtttttttctccgaagtgacatagaaaaagaaattgaatgtcagcctctgaaaagtgtccaaattactatttgaaaggagaaaaacacaatcaaataaggtccatttgtgttcatgctgagccccagggcttcctggctcccatcacactcagagctggttgcaggcgagagcccaagtcagcccatgtgttcttcaacctcaggtaagtttgtcttctccagtgttgatgaacacagaaggcactccttcctcagggctcagaggacagagaagccctgacactcactgcccagtgacctcccagcccccaacgataccgctcacccttgggtatttcatatttgctgcaaactttgtagcaaccacgagaaataaatagaaggctctccttcacactttgtacctgagaaaattaaggctggaagtgtggagggttcactggcctccaagcctcacccagaaagaaagtcatggagccacagagctcaacccaccctcagcatgctccagtagtgagagttgtggccaaagaaagctcagggcaccaagggaatgcagaggaaggggacccacccaacccagcaagagagggtgaaagggttcccagtgacccctgaggtccttgtagatggagggcaacttggcacaggctggaaaggtctggagacagagtacagagaggacagtgtacaaagacagtgtgcagagacacacagaatgaagaacatggcacccactgggaatgtgagcagcttagtgctgaagaaacacatgcaaaaaaaaagaaaaaagagccagagaagtgtgtggctaggggaagaggcagggcccgagggtaggtccatgcctctctggctcacaatgagaaatacctttgaatctggttccatagttatctgtcacctttacgttccatataactcatatgatttacttacaatgcttattattaatattttctgtctgttcaatgtcctatttgatagaatataagctccatgaagtcaggtatattctgtttgttcattgatcccaagtacacgtgacagagcctgccacagagaggaactcaatgcttatatctgtgggattggattaaagacattcaaataattattgaatgaaagagagaaagtcaggcaacaagaaagtgagagaaaaagggaaaaaggaagaaaaagagggaggaagaaagagcatggaaaggaggaaggatggagagacacagacagggagtgaaaaaaagagacaaggagttaatgctttctggggttgacgagaagaatccatgaaagaattttttagcagcggtgtgacatgagcaagtttttatcttcgggaaggaccacttgagcttgagtatgaggaagggcttggaggagggaatgaatgaaggcagaaaagcaggcccagagaaatctcactaaagcaactccagaaaagagagaaagatctgaactaggattgctgcaatacagatacacaaaagagaggttcaagagatgtttaggaggtacattcaactggtcttggcaactcatggatcggattggcagggagattggggagtgaaagaggattgccaagtgaatggtgatgtcacttacaaaagtggagaacaggttagggaccctgctttcttcctcacaattgtagctccagcacctagccttgtacctgacatacagtagccactctgtaaatgttttttgaatgaatgagtgagcaagggtggaagtgagtataggtagggggacagagaaatgcatatggaattcaggtttaggttagctgcttttgaaacctccctgcagggagtccaccaagaaggtggataggcaggtctgaagatgagaaaggggtcagggctgaggcttgagatttagaagttgtctatctgctgggggcggtagttgttgacagctgtgcatggcatcccctaacaaaagaaggagagtgtgtgtggaaaagaggcagagaaggaatgtaggagaggtacgaggagaaagccggggaatgcgataacttagaagccacgggagtagagagcttgaagacgaaggcaggggtgaaaggtgtctagtgtccaggaagacaaaggctgaaaggtactgctgtgtggtgcagtgagatgttcacctgggactttaaggcaagtggagtaggtagaagcacaacctcagagtggtccagaggagtgaaggaggcagaagtagtaaaggggacagtggaggacgttccaacactttccaactgccccatgcttcttctcaaacacaacagtattttagaggtatagagaagaatttctctgaatactgggattcaaactggggtcagggggctcctcctcctgctttcttttttccccattccccaatgtcctctaagtcaatccttctgtcctagacagagaaacttgtgccagaaaacacaggatatcctaaaataactccctacatgctaaaggaaaacgaagtgaacatttttcctttttaattccaaaatcatgcttgcgatataccttcaatgttgaagaacaagattccttagtttttcaccccggacatcaccttttccttacagagaaaacgtaaaatctaagtgtgtcttgttccccagagaacaaaaaggaagtgaaaattagatgtgcacatggtcggcagattgagatagacagattcctagacactctctggagttaagacggctgctctttccagctcacacacattgcatcatcttgctgttgatgtctcctcaaggatttgttccaacactctgatttgtaaaggacccagaacagagcttattaaaaactcaagacactatatctgatgggggagcatcaaggggccattaaacactcacctcattaatagcctgcagaatgagtccttttctaaagctcacacaagatggtgattagacagtcctggcatacaaacccatctctccatttttcaatcccttgccgagcaaaattttcaggccacaaattagaggtacccctggcttaaaacaaaacaaaacaaaaaggttgggattttaatgagccttctgcctctaaataaatctctctacccggcactcaagtcctctccagacttaaatgaaatgcatcgacaaagcaagtcatgcagtgggatgaatccagaattcaatatgagtcaaagtcctcctttctccaggccagcgtcctttatgttcattatgttgagtggtaagtttgtaccaagtggcgttaggcttactccacagttattatgcacatagtgactgtgatgatgtggtttccatcacctgggatcagactgtacttattctacagactgtctgaagttggggatgagtttggtgtcatccccatgggcagtcaataaatccttgcagccatttgcctgagtcaaggcgagggtttcactctctcaacagcctgagcttaccactactgcagtgctgaccattcagtgtcaaatgtcactgaggacaaataccacaaatcaccacatggcctgtggataccaatgggatatgtagtcttgtcacagatcacagcctccccaccttgctttctcctctctggatgcaatgacctctcggccaccttgtgtccaccacagagactttgcttgtcttgttccaggttccttgaactgttcttaccttctctgtccaactcctattcttccttcattcatttctagatcatcatttcctaagggatgtcttccataccctcacggattaggcaaatttccgctcttccatgctctttcttgtattaggttagtgcaaaagtaaattactgttactgcccctacctttaatggcaaaaacagcaattacttttgcaccaacctaatattttcatagtacttaatgtggctgttaatcaacattgatttatagactgctttcatgaatgtatgtgtccaccatttaaacaaattgtccagaaaggcaggggctatgtgtgctgttttattttgtcttactaatcactatatctccagcactgtagaagcctaattccatttttggttttgttttggtttactagtttactggcttgttttgaatgaggttaggcagcttgcctaagtgcatcaaggcgaatgagctccctgtgtcacacagcatcgagtaagtcatttctttcaaactctctctcaccgccagcttcaacaaaccaggaaacccatcaggctgtatcacctttgggcagaaatccccaggggcttgggcatcacgctgacaaagtctctgccaggtgttaggtgctggttcctatcattggttccatcaccccttaaagcggcttgcaacatccttgtaaagttctgttgttcggactcatgatcaagacacaaaacaattctcaggggcttgaatcagcccctcctagctgctactgggtgaacactgtgatttgtgacaggtaatttaaatgcaacaagtagactttcttcaaatgtagctgccactgaagtgagatgtttggaaagaatccactgtcctgtgggctttcttgtgttttctgtttttgtttctgttattttcatgttttaacttaaaaaattttaaacctctacctataagccacataatacccatacttaaaaagcaaaggtgaataaaaattcagattctcaggggatctatgcaagtcctggtttatcacgtatgagccgtgtgtctcaggaaactcacttcatttcactgatctttagagcttcagtctcttcacaggaatgacaaatagtatgaatcttaccaacttctagaactgcacagtgagccagatgtcaattatcacttaactgtgtctttaattaattcattcatttaacctattatttattcatctctggaccaggtacagtgctgaaggctgagaatccagtagtgaacaaaaacagccatgaaacctgcgctcaaagagcttatgatccagatggaaaagacaaatattaattaaacaactacacacgtgtaaaattgccattgaaattcacattttgtaagaaaagcttatggtgcattaagaatgcacaatgggggaaacagaacaatttagatggttgaagacttctccaaacaggagatgctggagtaggggttatctaggcaaagaggagaggacagaatgcctcttgcaaagaaggtgcttcatatgcaaaggtacccagataggaggcaagtgtgagggtctttaagatagccattggggtgagggtgaaagagactggttctctgctaataaaatgtatttgtattcctttgtacctaaagaagaggctattaccttcctctgacctctcagttgcccaagaatcttttcacagtttctatctaatccctttcaataattccctggctgctaatcagagaaaaggtgttaattcccttattagcatacctctgcctctctgtgatcacaaaatgctcctaacttcctccaccctgggaatgcccttggctttcactctggccctgtgtgctatctccctagggcttgttctcagccagggggaccagcctggcactcatctggtgccagcccctaattttactcagggaagattatttaagggagctgcccatgttcaggacacacacagtggatataggattgagctccaaacacagggctgctctcactgtgggacacagccactccctatctcatggaccacccaaggaagaacaagctctttcacttctgcgagcactcttcagtatttgggtcctgatactgtggtacctttaataaacttttttcatgccttcccatgtgaaaccccaattcactttgaaagacattaccagtaacaatatcacaatccacagttgttctctgcatgcactgggtggccagagtagtggaaataaagcaaatataaaacctaagaggcagcttctaataggaagggagattacccaaatgatgtcatcgcatcataattagcaatagggccagaattaccaaccacagcaaagcacgtcaaaatggggctatctcaactcttccttaattgggaaatttaacaaccgaaagatgcccctcgatgactctgaagggcttggtttctcgcatttcctggacctctttgaacctcacctgagaactcttctatagacttgggcaggtgaacatcacctgggcctctgcctgttggttttcagcagggttttcacattggttgcccccatgagcaacacttggccactgatatgaagggcttccccaaagaacacggttggcttgttttccatgttgattgtgcatgcttctctagtctttcctctcagttataccaggaaagagagatagtgataaactgctttagaatcacagctctgctatctccaagctgggtgactatgaggaagttgcttagcttctctgtgcctgccttcttcctccataaatgaagataactataacttctgcataagcgactgtgaggattaaaattggcaattgatgtaaaagcatctggcatgcaattaacttccaatacatttagttgttatcataattgccattaataacatccagcctgacctgaacttactactaaatccatcctccttgaatgctgacttgccacaaagccatggctccctcttgctgatgtgggcaatgttggtcttctgagatcatctttcttggcaaaccagaccgtgaattgccaaatttactactcctcatgcccatcaatgaccacacagacacatgcacacacacacacaggttcaaccccacttccatatctttagcaatggtctcctggggctctgttcccacggattttatctggcacagtatgtctgaggtgtgacccagaaatccgtatttttaagtagattctgaagcaaatagtctgcaaattggtactaggacagaccccatgggatggaagcactttgccaaagtgaactatcaggaattacagagagctggggaaagaatgcttgctgtgtattaggtttcagttgcatatattcgtttgcataccagattgcaagcagagggcagaaattagaacctgaatagcttcataccttacctccacctgtctccaagccacatatagtatgtgctaaataaacactaaagcataaactgccttaacagactagaaaatcgatacaagcatgggcttgttcactgatacatcccttgtgctggctgtacagaaggtgccagtgaatatttgttagataaatgaattaatgaataaatacagaggagttggtagggaaaaggcacaaaatgagcagaattggtgctaatttatgttgaatcagacaaatgttcagcttatgccccaaatttttacaaccatctcccttttaagtcactgaacaactgctaggagcctctgagccatgctaccccagaataccccagaatactcattcctattcaaatatttggttttcagtgttacaaggacaagtattcatttggaccagagaaataggctggatttgcactcatctgtcacagtgccctgaaatcagcctcaaatgattcacagccctcttgaaaacatctccaatctcctaagagataaaaagcctcactcattttcccacccctgacccaccaaccagcttccatccctaaacctagagcgaaattatgatgttctgtctcctcctcctatttctattcctcatgccctgcatgtctccccataggagctcataataggcttgtaggttccacctgattctgaaaatcaagttatggcaccgaggttttggaatcacttcaatctatttgcagagtgagcctggttagtatttaaatatgccacccaagctaccgatgtgcaacgtatcaactcttcacctgggatgatttattccaggagtcgccgttctgacttagtacacaggctttccactgtgctaaagcaaggagcccaaagaactagagggcttgccaatggttttcttgtggttttattcgtgtactaattaaaaacattggccaggcatggcggctcacgcctgtaatcctaacactttgggaggctgaggtgggtatatcacctgaggtcaggagttcgagaccagcctggccaacatggtgaaaccccatctctactaaaaatacaaaaactacctgggcgtggtggcgcatgcctgtgatcccagctactcagaggatgaagcaacagaatcgcttgaacccgggaggcagaggttgcattgagccaaaatcgggccactgcactccagcctcggtgacagagcgagatttcatctcaaaaaaacaaacaaaaaccatagcacataccagcaaacctagaaactcactgaaaccacataattgagcaatattaaaggcagagatgatgtggcttccaggttgacacccaactatctggcccaggtaacagatagtagaacctagtagtaaaaaaggaaaaaaatgagctttgcatataggaggggctcaatcaacaatgtcccatagtaggtaattcataaatatcagttgaataaatactgaatgaactagattgcagacacagagtttataacaacctaagtagagattacatgaaaaagttggatataattttgcatgtatacttttatcataaccttattaaataaacagataaaaaactatacacagaaaataatgcaaaaagataatacaccccaaaatactaagagcgactgttcttgggttgtagcatatggatgcctttacattttcttgcttctgcttttctgtatttttcaaattttccataattagcctgtttcttttataaatgaaaaattaactggaaaacgaggcagcctaggtaggtagggagagcatatgctgtgaagtcaaccagactatcttttattaattgtatcacttgttcctaacgtgtaatttttcttttttatacactttatttttatttatgtatttatttcagacaaggtctggctctgttacccaggctggagtgcaatggcatgatctcagctccctgcaacctctgcctcctgggctcaaaccatcctcccacctcaacctcccaagtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttgtcatttacgtgcaatttaatggatgtaaaatactcagcactatagtacttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatcctaacgaatgaaccacaaaagcatcatgctgaagcaaaagaagccagccacaaaacaaaggcatgctatacaagcccatttataacagaacagaatggaaattttataaaagttcaagaacaagcaaaactaatctatgatgattgaattcagaataatggttatcttggggttggtgagaagggagcaaataagaacttcatagggaactagaaatgttctatatctttgcaatgtatctatgtaataaaactgcacttgcacctcttaaatttaaacaaaatttttgagatttttcgtgaaaacggccatactgcccaaggtaatttatagattcaatgccatccccatcaagctaccaatgactttcttcacagaattggaaaaaactactttaaagttcatatggaaccaaaaaagagcccacaatgccaagttaatcctcagccaaaagaacaaagctggaggcatcacgctacctgacttcaaactatgctacaaggctacagtaaccaaaacagcatggtactggtaccaaaacagaacagaacagagccctcagaaataataccacatatctacaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggatctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgggactgtaaactagttcaaccattgtggaagtcggtgtggaaatcggtagattgctcagggatctagaactagaaataccatttgacccagccatcccattactgagtatatacccaaaggattataaatcatgctgccataaagacacatacacacgtatgtttactgcggcactattcacaatagcaaagacttgaaaccaacccaaatgtccaacaatgatagactggtttaagaaaatgtggcacatatacaccatggaatactatgcagccataaaataggatgagttcatgtcctttgtaggggcatggatgaagctggaaaccatcactctcagcaaactatcgcaaggacaaaaaaccaaacaccacatgttctcactcataggtgggaactgaacaatgagaacacacggacacaggaaagggaacatcacacatcggggactgttgtggggtggggggcggggagggatagcattaggagatatacctaatgctaaatgacgagttaatgggtgcagcacaccaacatggcacatgtatacatatgtaacaaacctgcacattgtgcacatgtaccctaaaacttaaagtataataaaaaaaaattttactctaagttccaggatacatgtgtagcatgtgcaggtttgttacataggtatacacgtgccatggtggttggctgcccctatcaatctgtcatctatattttaagccccgcatgcattaggtatttgtcctaatgctctccctcctcttgccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagtagtgaaacatgagtcactgttaagttctcacgatgaaattctcactattagttcagcactattaagtgactcatgttcgacacttcagtggtagattctgtgttcagcaggtcccacattttgaaatttggggtgaattcttcctgcgactctgtggtaataaagaatatgaattatgcttacaattgcaaagatatggaacaaacctaagtgcccatcagccaatgagtggatcaagaaaatgtggtagatatacaccacggaatactattcagtcataaaaaggaacaaaatgatgtcttgcagcaacttagatgaagctggaagccattattcgaagcgaagtaactcgggaatggaaaaccaaatatcgttatgttctcacttataagtgggagctaagctatgacgatgcaaaggtataagaatgatacaatgggccgggcacagtgactcacgcctgtaatccccgcactttgggaggccaaggcgggtggatcacttgaggtcaggagtttgagaccagcctggctaacgtggcgaaacccgtgtctactaaaaatacaaaaattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactttggggacttaggggtagggaaagtttgggagggggtgagggataaaagactacaatagttagtagtcttaggtgatgggtgcaccaaaatctcagaaatgaccactaaacaacttatccctgtaaccaaaagcacctgtaccccaaaaactattgaaatagaaattaaaaaaattttaaaacagtatgaattattaatgcattaggaggcaaagacagtgaaatgtcagaaagaaagacacttatgactgcggttggaattcatacagtgtttcattatttccaaaggtagtccccatctattatctcacgtaaacctccagacaacccagtgggtaggcgttattattgcaacgtgattcttactcccattttgcaggaaaaaaggaggaggctgaaagaggttgaaaatagatacaagttaatctccccgacactccccctatccattcaatgacaatctctctaggctttgtattgcttccttccttcttctctcccctgcatctatcatttctttgcctctattgacttgtatgtatgtatgtatgtatgtatgtatgtatgtatgtatgtatacatgtacgtatgtatgtatttagagatggagtttcgctcttattacccaggctggagtgcaatggtacgatcttggctcactgcaacttccgcctcccgggttcaagcaattctcctgcctcagcctcccaagtagctggaattacaggcatgcgccaccacacctggctaattttgtatttttagtagatttggggtttcaccatgttggccaggatggtctcgaactcctgacctcaggtgatccacccacctcggcctcccaaagtgctggaattacaggcatgagccaccatacctggtcgtatttatttttttgacagagttttgctcttgttacccaggcgggagtgcggtggcgtgatctcggctcactgcaacccctgactcccgggttcaagagagtctcctgcttcagtctcccaagtagctgggattataggtgggcaccaccacacccagctaattttgtaattttagtagagatggggtttctccatgttggtcaggctggtctcaaactcccaacctcaggtgatccgcccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaattcagagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactcgccacttaatgagttagtgttccccaaggctctgtgttgcatccattgttcctcactgggtacatcatttacttggacattttatccatccttcatggttttaaatatatgccaatgccttccaaatccagatcattccactgggctttgatatttaaagaactggatgttcatggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgctaaacatcctacaatgcacaggaaagctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacactacagttcaagaatcacactctaggtagagccaaccttgacgtcaaagaaatctcgagttcttgttctgcaccaagcattgggatccctaatacagaaaaaagcagctcaaattcaatgtttgagtaagcacttgacttcagccttcaggatacaacctgctaggcctccaggtgaataatttaacttgttttctctttattagcactattccagaaaaaaattgacctgtaaggttcatagtccaaagcaacaagtctttaatgtacaatccttttcttagccctggagcttggagattatttcttcaagtttaaagctaggaaatagagcagtgttttggtgcattgcccactagagagactggagtagagaccaatgcaggaaaatcctgaaaccttttcatcttattaagctcagtttatattttaaaacatatgaaagaaagtgcttttgagatatggagataaagatacgatagatctgctaaggaaaagaggccttgaggattgtttagattcacttggctgctggagggccctagaaagaagtaaattagaggggaaataaatctggaatcgagttcttgctctgccttaactgactgtgaatttaaaaaaaatcattttggttcaagaaatatgtattaaggatctctgatgagctagacacaaagttaggtactgaagataaaataaataaagcaggcagagtcccctaccttaagaaaattacaggctggtaaactctcaacaggagaaatattggatatatcaaatatagttccttcccctgagaaacgcagactggttggtgagacagacaaatagattttatgatttcagaacaatgtagtaaatgttaaagtattacagaatgctatggaataatggagagatgagaggcttattcaccctgggaaataaaggaagcctttctggagaagacaaagagttgtgtagatagtcatttgagaggcaagactggggggaaggggagaggctagaaggctatttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaatagaaaagcctaattttcagtaaaacagaagcttccacttcttccctgatataacaatttcccttgggtatgtcaactcaaaactcaaccaccatgctttgtgaaatccaagccacataaaaaggttacattaggcagtgagctacgcccccaagccaatagccagctccatccacttagccatgtcatgagccatctcatacatttcagcccaactgtgctctcagggaactgtagcctcagctgttattacatgcagcagaaaaaccacctagtagagcccagtcaacccacagaactgtgactgacaataaaatgattcttgtttctagctcctgtatcttgtagcaagaatatataagaatgtaaaactgccaatgtcgggtaagaaaatgagatggctgaagatgatgacatgtcagtctaactttaccataaaaattatctgatctagtttatctgaaaaatagttccagcagtgtagaagtttaagaaaacagcagaagatagccagagttctgcttctggtatggtaggaaatctcttaacagattccctcccacacccaaacaggtaaaaaattaaagctagaaggaaaaaaaaaatatacctgaaggctctgtagagtaaaaatagccagtagatttcacagggacattgaaacatggaagaagggctcatcatagagttctacatttttgccacctaggtctgacagcatgctgctgtcccaaaatggcaccgggtggctcaacatctagtggaagagccaacctctttctggcctgaggaggtggaagttagagacctggaagtccacggccagcagaatataaaaaccccagaaagaggagacttagagaagggaattcttggcatgtatatgtaaactctgcccaagcctctggccagtccttgaacaaagggtgagtagacaaggctcaaagtagtttgcatttaaacccaacaggactgagaactaagcctccacctgagagacagatatggaaatgtaagtataaccaggttagttacctgctaagacacaaatatgaatactctttaaggaaatataacccacaatatagcattcacaaagtgctagtacaattcaaaattactttacatataagaagtagggaaatctgacccattctcaagcaaaaaagacttactttacatataagaaatagggaaatctgacccattctcaaggaaagaagacaatcaacagaggccaatcccaatatgatccaggtgttaaagcagctattctaacaatacacttaatgaggtaaaggaaaatatgctcatcacaaagaaaaaggtaggaagcctcagaagaggaaaataaaaaaaagaacatttagaaatgaaaaacaaaatatctgaaataaagaatttactggatagaactaacatgagaatgaagatgacataggcaggagtcagagagcttgaagatagatcaatagaaatgacttaagcagaggggcttttataaattgacagagtgagatctaacatacatgtgattaaagtgtaaccacccaagatcaccttgccactgtctagacagagccgatttatcaagacaggggaattgcaatagagaaagagtaattcacacacagccagctgtgcaggagaccagagttttattatgactcaaaatcagtttccccaagaatacagggatcagagtttttaaggataatttggtgggtagagggccagtgattcaggagttctgattggctgtctggagatgaaatcacagggcgttaaaattgtcctcctgctgtgagtccgttcctgggtgggggccacaaggccagatgagccagtttatcaatctgggtggtgctaactgatccatcagatgaagggtctgcaaaatatctcaagtaccgatcttaggttttacaatagtgatgttatccccaggagcaatttggggaggtttagagtcttgcagccttcaactgcatgactcctaaaccataatttctcatcctctggctttaggcaatccccaggcaggaagggtgtttgttttgggaaagggctaatatctctttgtttcaaagttaaactataaactaagtttctctgaaggttattttggcctacacctccgcccaggaaaaacaaggacaacttggaggttagaagcaagatgaagtcacttaagtcagatctctttcactgccatgatttctcagttataatttttgcaaaggtggtttcaaaagttcctacaagaaagagaatggagaaggggaaaaaatattgaagaataatggccaaaaagaaatttggtgaaagacataaacttacaaattcaagaaactcaaagaaccccaaataggacaaatgtggagaaaaccatgctaggcacatcacagtcaaactgatgaaaatcaaaagaaagaaaatctcaaaattagcaagagaaaaatagcacattatatatagagaacaatgattcaaatttttcacagacttaagattagaaactacagagtccagaagacagtggaataatgtctttataagtgctggggggaaaaaaaacaaattctataattagtgaaaatgcccttcaagaatgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaagagcattagaagcataaatatctggataagcataaaagactcttcttttaattaaaaaaatacatatgcatgtgactatttaaagcacaaatccttacattgcctcttagggtattaatgtacagatgcaatgcatataacactatagcatacaggatggtgagggtggaagaagagagacaggccctctcacattgttttatacggttttatactcagaaaaagaaagagaagcgaaactaaaggcagttagcctggtgcctaggaaccagacccaaaaccaaggaaccagacccgaaatcaggcctgggcctgcctgacctaagcctggtagttaaagatcgacccctgacctaaccggttatgttatctatagattccagacattgtatggaaaagcactgtgaaaatccctgtcctgttctgtttcgttctgattaccggtgcatgcagcccccagtcacatactccctgcttgctcaatcgatcacgaccctctcacgtggacccccttagagttgtgagcccttaaaagggacaggaattgctcagtcggggagctcaactcttgagacaggagtcttgccgatgctcgcggccgaataaacctcttccttctttaactccgtgtctgaggagttttgtctgcggctcgtcctgctacaaggggaatgagtaggccctatactgaaaagtttctacattgtatgtgaagcaatgcaataccaaccctaagtagcctgtgaaaagctaaagatgtttcatgtgatccctagagcaatcactttaaaaatgcaaatagagataatttcacttcttcctttccaatttggaagccttttatttctttttctggcctaattgctctggctaggacttccagtactatgctgaatagaagtggtgagattgaacatctttgtcttgttcctgatcatagaggaaaagctctcaattttcaccactgagtatggtgtttgttgtgggcttgttgtatttgacctttattggatatacttctatcatgaaaacactcagaaaactggttatagaaggaaatagtttaaattttataggaattaaagtattaaaatttttaaataattttctgcatctattaagataattctgcatctattgagatgagaggtatagattaaaagccaataaataagttaaaacaaagtgtgtaaatactctaaaaatccataaaaaggcagatataatgggcaaaatggatcccccaaagatgtccacacctttaaccctggaacctctgaatgtgttatgttacatgaaaaaagtgattatggacctaaaaacggagagattatcctggtttattccatggatcctactcacaagtcccctgaaaaacagagaactttctccagctggagtcagagaagtagcagagaagaagtcagagagactcaaagtgtcagaagatcttcattcaccattgctggaggagctacatggaaagcatgagaaagaagtctctaggagcaaagaccagcctgccatccacagactgcaaataaatgggaacctcagttccacaactcttcggtttgtgaatcattcgtcacagcagcaacagaaaactaacagagcaggaaagggagaagagagacatgaaaaacagaggggaaatacagaaacaacaataaacatgccaaacccaaacacatcgataactgcattaaatgactgtggactaaaagttgaagactctcagaatggatcaaacaaaaacaagaccaactattctctacctacaagagatgtactttcaatgtaaagacgcagacagattcaaagtaaattaatggaaaaagatacaacacacaaccagaaaatgttagaagaatggaccatctttattagcatcagataaaacagacttcaagacagtattcccggaggggcatttcataatgagaaaagggtcaattcatcagaaagatataataaccataaatgtgtatgaacttaataacagaacccccaaaaatacagaatggaactaaaaggaaaaatagacaactccacaatcacagtttctcttcaacttccatcacagatatttcccattatttattattagtctataaaccaactttttaaaatgtaattaagctattctaaaggaaattttatagcttacataaatggggagcctcgtgtcacttacataaataatcaccttgaacataaagcaaaccatatcattaaatcctggccagacaccatggcatgactactatgtgagtctgtgttctttaactggggctgtgtaccacctaaagccatctcatttacctgaggtgatatgcagccccatattctgggaaacacttatgtaacctaactctctcacatgtccaaaggaggacaggacactaactggtctcctgtaaccaaacaagttgctgccagatcccggtgttctgatcctttgttgaacgttccttcctctgttctgtgagtcttttattagcattaagagtggaacccaagcctcctctttaaagttggcgtttgaaacccaacagaaaactgcaagctccaggaccctgaaccaactgagactcagaagtgctggtggcattcagcatccaagaacacttagagccaagtttgtgctgtctttttaacacgactaataccatcagtggaattaatagaaaaatgaaagccggcactctaattccagtaatgaaatcacaggcgcacagctcccacctttaggagcctcacaaatgatgcatgtcctctgaagccattcagctggcgtcacttgtagatatatccctccgagggaagccactatccatccggtggccagcctgacaccacatcgcgtgacaaatgacatctgagaaccaagtcgtaccaggcaaaggctgccacatgagtggaatacaaaatagttttctgcatgtgttcagttcactgctgtaaataagattcactggagacctgaaacaggagggcccaaaataattttggttctgattccgacaacaaagaaagagttgactctccaccttctctaactgatcatagtgattaatctctcaccagccagtttattacatagtcctgctcaatctaaagctggcatgcaagacaccattttcaaaaattaaacaagccaggtgtggggacacatgcctgtaatcccagctacttgggaggctgaggcaggaggatcgcttgagcccaggaatccaaggctgcagtgagccatgactgtgtcactgcactccagcctgggcaacagagcaatactcttggagcaagggaggaaggggggagggagggaggactgaccggagtttgaatcctgggtttatcatttgctaattgagtgattttaggaagttatttaagccttgaagtctccatttcctaatctgtaaaactgaaaaaatagtattacctcaccctaaatgagataattataattaaagttaatttcattgcatgccatctgccagatactatgttaagccctttatgtgtagaaatgaaaggagagttctgtgcgcacgctaggtgctctgtatacagcgtaccacccactccaaagctgagagtggaaggcagagctcaagcaatcattaaccacagcacacgttcaggcagctttgccactaaattttaaccagtacatatataaaagtgtcccactctcctcctcatatcccatatgcacacgtgcacacccatgtgtgcatgtactcacatgtgcacacacacacatacacacacacttcaattcggtcggcttttccttggggagtagactttggtgagtaaatacctctcttagctcaatctcagctccaagcaaattgaaaatctctactaattcacaaaaaaataaaaataaaaaaataaaactttttaattaggtcaaccctgcagcttaacaacgaagatgaagaaaaagatcttgggcaagaacaagacagctgtggtttgagaagaaggcactagacttggagttagaacttggatgctggctgtgccatatattcactggatgattttggacacattcttcacctttctgagccttttcttccatgcaaaatgaggcagttggatgttatacttctaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaatgcagttacagggacctggctcagcctcttcctatctgtgtgaacttgggcaagtcttttcaccttgcttaccctcagtttgctcatttcgagaaaggtgataattcccagccttgctggtttattgtgatgattaacatgagtatggaaggtggttagtactttgtctgctccttagtccttctcctcctcctccctatcctcttcctcctctcattcctctccttccccttcctcctctacttcctcctctttctcctcctccctttcctccccatcctcctcttactcctccttaatgaagcaagatcttccctctgtaagaacattacatttcttccactccatgacctggctcaagttcactatgaaaatgatcactgccagtaggaaaattcctccagaaggatttttatcacatttccctttgaagaggagcaaggaatcaacaattggcatcccttggaagatgaaagcaagttcctctgtattcggaacggatgttcctctggaatcagagtaatctcttaatggaccctgatgacataacgtggcacgggcttctcgtctgaaatggcaggttactcagcaagacagagggagagaagcagatggatgtgacagtaaattctgctatgtacccacagacacttctaagacattaaaaagtagtgcccacatttccgactcccacaacgaaacctgtgaagaaatcctgacgttgatttcaggagcatgtgggatcttgcctctcttacaatgcgggtccctcactctggttatgccaagcacagcttaaactgacccctctggttgtgagaaagtaagccaagaggagactaagattctaacaggtttattttatctactcaaaaggaacactagatctggagtctggtgaagaagattcaagctctcattctgtgacttactagcaatgacacagagggttgcctcagttgccttatctgtgaaatctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaccacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatgtatatgtatgtatttatctaggacttatattctgtgtgtgtgtgtgtgtgtgtgtgtgtgtgtatgagataaaagtatatatacccaagatatttatattatattgaaaatgaaactatagactctggtgatattggaaaattcccctatataactagggaatagtccagacatggtagctcagtcctgtaattccagcattttgggaagccaaggcaggcagatcacttgatgccaggagttcaagaccagcctggccaacatggtgaaacccccatctctactaacaaaaaaaacagaaaaagaaaaattagctgggcatggtggtgcacgcctgcagtcacagctacttaggaggctgaggcacgagaattgcttgaacccaagaggcagaggttgcagtgagccgagatcacacgactgcactccagcctggacaacagagactgtctcaaaaaaaaaaaaagagagtgataccatctcataccagttagaatggcgatcattaaaaagtcaggaaacaacaggtgctggagaggatgtggagaaataggaacacttttacactgttggtgggactgtaaactagttcaaccattgtggaagtcggtgtggcaattcctcagggatctacaactagaaataccatttgacccagccatcccattactgggtatatacccaaaggattataaatcatgctgctataaagacacatgcacatgtatgtttactgcggtactattcacaatagcaaagacttggaaccaacccaaatgtccaacaatgatagactagattaagaaaatgtggcacatatacaccatggaatactatgcagccataaaacaggatgagttcatgtcctttgtagggacatggatgaaggctggaaaccatcattctcagcaaattatcacaaggacaaaaggccaaacaccacatgttctcactcataggtgggaactgaacaatgagaacacatggacacaggaaggggaacatcacacaccagggactgttgtggggtggggggaggggggagggacagcattaggagatacacctaatgctaaatgatgagttaatgggtgcagcacaccaacatggcacatgtacacatatgtaacaaacctgcacgttgtgcacatgtaccctaaaacttaaagtataataataaaaaataaaaataaaataaataaataaaatattatattaggaaaaaaaaaagagagagagagagagaatagtttcaccctgtaaagtccttagaggaggaaaaaaagcaggcctgggctaaaggtgctaaagaactacaagacaggaaatgcacaaattaccattagaataaaaactgaaaatgccatccatgctgtttgttgttcacttactgaccaggaggattccttctatgatctcaaggcagcactgccatgctgctcagcgcctccaatcatgtctcaaggtaattgggctggtagatgtttacctatctgcaaagcttagttatgatcccattaggtcatttccagaaaggttcacataaacttgggtcactttatattctttttaaacttgtcatcatgggaaatgtcaaacatagaaaacagaaaaaatagtataacaaacccccatgtatcctccactcaattttaactattttcaattcgtgactgatcttgttttgtccatattcttaccaatgttctccttccaatgcattattttgaagtgaactccagatatcatatcattcatctgtaaatatttcagtatacatctctaaaagtcaaggactcctttttacaaatatcatcacaataccatcatcacactcaaaatttaccttaatccttaatattatcaagtgtctggtctgtgttcatatttcgctgattgttctatatacttttagaaaaatcgtattcttttgacttagaatacacacaaggtctatatgattaatatggtatttatttatgtatttatttttgagacagtcttgctcttttgcccaggctggagtgcaggggtgtgatctctgctcactgcaacctctgactcctgtgctcaaatgattctcctacctcagcctcctcagtagctgggattacagacatgtgccaccatgcctagctaatttttgtatttttagtagagacgggggtttcgccatgttgtccaggcaggtctggaactcctggcctcaagtgatctgcccacctcagcctcccaaagtgctgggattacaggtgtgagccccgcagccagtgtaattaatatgactcttgagactctttttatttcattgcatttttggttttaaaaactgggtcttttgttgcagtttccaatagtctggattttgctgatgacatgcccatgatgtcatctaacaggcttatgccccctcccatatttgctggcagttcaggccagaggtagatgcagatctcacttattttgccaggaatacttcataagtgatgtgtgtactttctttaaaaaataaattttctggttgtcttttgtaacattagcaggcattgacaataattgcctggatccattagttcattaacgtttgcaatgtagggatattccaattctactattccttcttcatttattacccggaactacgccaaaaagagaaatcttcctttgtcagctatttggcctgaggaagaactgatacaagaagggcagaatacagtaaacgcatgcttcttcccccatgtatgttttcagaacaatgaattggttccctagcatcctccaagggttaccaattagttatcttttaaaatatcttattattacaaactcacggattttatgtatttcaatgccctgcaattagtatcttcattgatgcccaagctgttccatctttggccagttgatttcagattggcttctgagtccctttgacctgtagtctttggtaactgctttgctcattgcagtgacaagacactctaggaaggtttatcttgttcatttccaccctacaccttgaatcacccactttcccagtggtctccctcagtggaaaataatttaaaaaccaaactctaagtggaggagtacttagttttactaggttggttactgttctaggatatatgtattttaagtaaaaatacatcataagttcatactgatactttttaaattgacattgtatattaatatttatggggtacggtgtgatacttcaatacatgtatacaatgtgtaatgatcaaggcaaggtaattagcttatccatcacctcaaacttgtcatttcttgtatttagaacattaaaaagtctgcttttctagctatttaaaaatacacaatatatttttaactatggtcatcctacagtgtgatagaatactagaacctatgcttcctgtctagcgtaattttgtatcctttaaccaacctgtggctacacccttcctggcctctagtaaccactaatctactttctacttccatgagatcaatgctttgagcttccacatgaagtgaaaacacgtgatatttggttttttgtgcctggcttatttcatttaacatagtgtcctccaagctcatccatgttgccacgaatgacaagatgttgttatttattctttttttttttttttgagatggagtctcgctttgtcacccaggctggagtgcagtggcgtgatctcagctcactgcaagcttcgcctcccgggttcacaccattctcctgcctcagcctcccgagtagctaggactacaggcacccgccactatacccagctaattttttgtatttttagtagagacggagtttcactgcgttagccaggatagtctctatctcctcaccttgtgatccacccgccttggcctcccaaagtgctgggattacaggtgtgagccaccgcgcccagccaagatgttgttattttaatggctgaatagtattccattgtgtatacataccacattttcttcatctgttaattcagtggttgattcaatgtcttggcccctgtgaatagtgctgcaataaacatggcagtgggtaaagaatatctcttcaacatactgatttcctttcctttgaatatttacccagtaatggggttgctggatcatacagaagttctacttttagtatgaggaaactccataccgtttttcataatggctgttctaaattcccaccagcaatgtatactagttctctttctccacatccttgccagtatttactttttgtatttttgataatatcttttctgagctgagattatatctcactgtggtttcgatttgcattttcctcatgattagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgattttttcctttgctgagcagaagcttttacatttgtctatttttgctgatgttacctgtgcttttgaggtcttctctataaaaatctttttgcagaccaatgccctggagtttaccctgttttcttctagcagtttcacagttttaggttttacacgtcagtctttaacccattttgagtgtattttgtatatggtgagagatagatgcctagtttcatccttctgcatatgaatatccacttttccaagcaccatttctgctgtagctgttgtcctcagaatggtctgcctcattttccagtagtacctgatgatgatcttgaacttcccaaactctcagaggcatcacgagtaacttggtcttgtctttactttctcacacgcagtttctaacaccacatgggatttatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgtgcacacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgtttattagtcagtgaattaagaggaaaatatcaaggagacatctgcactcccatatttgttgcagcactactcacaatagccaagatttggaatcaacctaaatgtcaacagacaaatggataaagaaaatgtggtacatatacacaatggagtactgtacagccatgaaaaagaatgagatcctgtcatttgcaacaatatggatggaactggaggttagtatgttaaatgaaataagccaggcacagaaagccaagcttcatattcccacttatttgtgagagctaaaaaaaaaaaaattaaaacaattgaactcatggaggtagagagtagagtgatggttaccagaggctaggaagggtagttgggggatggtatgaggtagtgatggttaatgagtacaaaaatatagttagatagagtaagatctaatatttaatagcacaacagggtgactacagtcaacaatttattgtacattaaagagtaacagagtataattggattgtaacacaaagaaagggtaaatgcttgaggtgatggataccccatctactctgatgtgactatcatgcattgtatgcttgtatcgaagtatctcatgtaccccagaaatacatatgcctactttatactcacaaaaattagaaataaaaaacatttttaactgatattttataattatataaattcataggtacaatatgatgtttttatatacatatacaatggaatgatcacacaactttaaaggaaaagacaattacccaacctcctttggaaacagaaatcaacagcattgttccttctggctgggtaccgagataagaaaggaaatctgtagaaaatcctacaaccaaggaaaagaaatatgctactaccaagaaaaagtgcttatggagaagttgtcataacatgatgaactgaaattatgacgttaggtgaataataaaagtgaaaacaaaatgtatatacaagccaatcataaaaatatttgtaaaataataagattgaaaaacttcaccaaagagttacagttgtggtgaaattacaagtgatctttgtcgattttattttatagtgtatttctgttttaacaatgtacaataaccaaaaggctcttttaaagaaataaaatgggccgagtgcggtggctcacacctgtaatcccagcaccttgaggggccaaggtgggcggatcatgaggtcaggagttcgagaccagtctggtcaacatagtgaaaccccgtctctactaaaaaatacaaaaaattagccaggcgtgctggcgggtgcctgtaatcccagctacttgggaggctgaggcaagagaatcacttaaactcaggagacggaggttgcaatgagctgagatcacgccattgcactccaacccaggcaacagtgcaagacgctgtctcaaaaaaaaaaaaaaaaaaaagaagaaaatgtttattttgtcagtattttatctttcaagatctagatatcaccttttccttcttccataaatactacaacctcacataggtattttctgtcctccaattgtgtagagtgctagtaattcaataacttagcatcaaaatcaccctaatgagcttttcagtgtgcatatacccgagtttccttccagcaccactgaatcagaatctctggatatggtacccaggaatctatattctgaaccagcatacttggcatcattgatgcaggaggtccatagactccagtaagagacattgtattagggactccacttttcactgagcacataatttgatacttactggtatggctgtttgttattgcagagcatgtctggtccctgcaaccagattactaattatgaaaaaacagaatctaaccctaaccctaacatggcccagacctcgctaaatgattttaggcattaggccaatacagatggcctaaagactttttatatttcttccttttataaaacattaattttgtaggtgcatatgaaagccaactcactcccatttataactcagaaactatggaagcaaaaaaaatgcagctagaataatgttgttttctttgtatactgttaggcacagaagtggaattccacctattcactaagaatagtagctacctgataacatccagttatccaaatgcagtaaaataaatgagggcataagaaagcaaacaaatacgccaaaacatatttcaagagtagcatacaaaaaatatctagtcagctctcccttaagctaaggaaattaaaccaatgaccccaatagaagaaaattattagacattcaaattctgtatatttggcttaaataaaagcaaagaaagatggagaaggtctcattcatgtgagatctgtttactctgcacagcctatgtcagaggtaatggtcttaaatagttttaggaggatctaggttgaactcagatctgaaccaggtagaaacacccattctaaatggagaaaattcccaagcatggagtcaatttaatacatttcgagagtttactctacaaaagccaacatctttccagacttggggcaggaggttctctctacccaggagataaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaatagaagaataccagatctcaagagaagtaggagcctgcatcactacagttgatgtcaggggcaggaatcaagagtgaagaaaaggagatgtcaagatgtctggggagtgtgtctctcctgaacactgaaggaaagagatccataggggtgtgtgtgtgtgtgcgtgtgtgtgtgtgtgtgtgtgtgtgacacagaaagaggtcttacaaacacacatttttaaatttttaatacataaaaacagtggacaaattataccactcaattttctacaatttgaacacatccatacaaccattttccaaaatcaagcttcaagatacagaacaccagaaaccttcctccagctcccccaagtctatatcaaatccccaccatggttgtccagccatctctctccttctctgtgtgtaccaattaatctctctctctctctctctctaacacaaacacacatttttagcaaagacaatgaatattcaaagagcatcttccatatgccaggctgagtgataggtgccttaaacaatatcatcttcacaacaaccctctcaagaagccattattatctccattatgaggaacagggaatttaaataacttccccaggttgagatggttagaaccaagccaagatatgattaatctcaaataagactaactatcggcccaggttctttccacaatactgcaggtccctccatgctcccacttttgatggaatgtagcccaagatcccccagaacagaaccatgataaccagacaggaggagggtcctacaactaactctcattttcccttcaagccaatattgaagacttgatatcttggtccattattctgtccaaataaggaaaggaaacaatgttgaatcttgatacgtgacctgataagactttggtgctctctgaacatccatcttctttgcctcaaaataaaaaatatagggttgatgaatgggcaaggcaatcctaagcaaaaagaataaagccaaagccatcacattacctaacttcaaactatactacaatgctacagtaacccaaacagcatggtactggtaaaagacacatagaccaatgaaacagaatacagaccccctaaaataaagctgcacacctacaaccaactgatctttgacaaagtcaacaaaaataagcaatgaggaaagaacccccatccaataaatggtgctgggaaaactggctatccatatgcaaaaggctaaatctggacccctatcttttactatatacaaaaattaacccaagatggattaaagacttaaatgtaagacctcaaactataaaaaaatcctagaagaaacctaggaaatactgttctggacattagcctaggcaaataatttatgactaagtcctcaaaagcaaatgcaacaaaaaaaaattgacaatcggaatctagttaaactaaaggtcttctgcactgcaaaagaaactatcaatacactaaatagacaacctacagaatgggggaaaatatttgcaaactaggtatccaacaaagggctaatattcagaagctataaggaacttaaatcaagaaaaaaaacaaataactccattaaaatcaggcaaaggacatgagcagacacttctcaaaagaagacatacatacagtggtcagcaaacatgaaaaaatgctcagcatcattaatcataagagaaaagcaaatcaaaactacagtgagataccatctcactccagtcagaatggctattattaaagaatcagaaataacaaatgttggcaaggttgcagagaaaagggatatttatacactgctggtgggaatataaattagttcagccccagtggaaagtagtttggagatttctcaaagaactaaaaatagaattaccattctacccagcaatcccatcactgggtatatgcccaaaggaaaataaatggttccaccaaaaatcccctgcactcatatgtttatcacagcactatttacaatagcaaagacatagcatcaacccacatgcccatcaacaatggaatggataaagaaaatgtgatatatatacactatggaatgctacacagccataaaaaagagtgaaatcatgtcctttccagcagtatggatgcagctgaaggccattatcctaagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacacgcgcgcgcgcgcgcgcgcacacacacacacacacacacacacacacacacacggttgatggaaaatgaatgctgcctctagatactgactcaacagtctcaactatgttcttacattggcatttttttttttcacctgtctccttctcaaaaggtcaagagcaggagaaatttcgcctaacagagtttgtaaggtaggttttggataatactattttcttattttaagaaataacttgggctaggtgcggtggctcacgcctgtaatccaagcactttgggaggccgaggcaggtggatcacctgaagtcaggagtttgagaccagcctggccaacatggtgaaacctcctctctactaaaaatacaaaagttagccaggcatggttgcgggtacctgtaatcccagctactcaggaggctgaggcaggagaatggcttgagcctgggaggcagaggttgcagtgagctgagatcacgccactacactccagcctgggtgacagggtgagactctgtctcaaaaaaagaaaaaaaaagaaataacttgataattctaagatgccgatgtcctcattaaaaggaaaatggaaaaaggcaaatgcctggtatttcttaatgaaacactacactcagcacattataggagttatcagatttaatgcttccaacgacttaatatcaggtagtattattaactccatttgcaaagaagggatccaagtcctagatagaggaaatggcatccccaaggtggagaaccagttcaatcttggtcctctggctccagggttcagctctgaattagtaagtggtcctacaggtaaaataaatgatatgatttcaagttgcaatcatggttcttttaaaaatagatttaagggatacaactgcatttttgttatatggatatattgtgtagtggtgaagtcttggcttttagtgtagctgtcactcaaaagtgtctattgtacccattaaataacttctcattcttcacctcctcccattcccctcaccttcgagtctccagtgtctattatgccaccctctgtgtccatgtgtatacattatttagctcccacttataagtgagaacatgtcacatttgactgttttggagttgctgcacttaagggcctcaacacatatacaccatggaatactatgcagccataaaaaagaacaagttcatgtccttcgcagagacatggatgaagctggaaaccatcattctcagcaaactaacataggaacataaagccaaacaccacatgttcttactcataagtgggagttgaacaatgagaatacatggacacagtgaggggaagatcacacaccagggcctgtcagggggtagtgggcaaggggagggatagcattaggacaaatgcctaatgcatgcggggcttaaaacctagatgatgggttgatgggtgcagcaaaccaccatggcacatgtatacctatgtaacaaaactgcacgttctgcacatgtatcccagaacttaaagtataataattaaaaacaaaaaagataaggacgtcaagttccctccatgttgcttcgaaagacatgatgtaattaccttttatggctcagtagtattccatggtatgtttatatcattttctttatccaatgatccgttcatggacacttgaaaagatagggaatcaatccaagttgcaatcctggttcttaataagaagccttctcagaggataagctagtttatagaggaagctggatgaggtaaagaggaggctttataagtctattgtctctcaagctgatgttcccatgtgaagatggaacagggaagacagattctatttgctcagcagaaaaggccaacttcactctcagccagttgttcacaaacagcaaattgtttctgccctatttctttgtaccatcaaagaaaagaaacaggccaatatatttctcagttcccaaagttaaggagaaggtgtccgtggtgaaaataacccgcctcgttttagctccttccaccggaggcaaggaacaggaccaactaacatgttttctgaaacgaatgctctggatatttgctgatggggcaggttataaattgttcttgaatttatgcagaggctcactttgcatcaaccagggctaataaatcaggatgcagagaaatcaaggcagctgtgcaaaatacagttcacatggaagtgtggacagtggacaaatctgacacagagagacaatactcggctatgtaaatcggtgcataacataaagcacaatgtgcatactacctgggactgaaattatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctcatctctaccaaaaatacaaaaaaaaaccccaaaaaattagccaggtatggtggtgcacgtctgtagtcccagctactcctcgggaggctgaggcccaagaatcatttgaaccctagaggcagaggttgcagtgagccgagatctctccactgcactccagcctcggctacacagcaagactctgtctcaaaaataaataaataagtaaaaataaataaaataaggttggatatgggggttcatgcctgaaatcacactgttttgggaggctgaggcaggaggattatttgaagccaggagttcgagactagtctaggcaacatagtgaaaccccatctctacaaaaaaatttttaaaaagaaatagcagagtatggtggcctgcacctgtaatcctacctacttggaaggcagaggcaggaggatcactgtagcccaggaactcaaggctgcagtaagctacgatcatgacactgcactccagcctgggtgacacgaagtgagaacccatcactaaaataaaataaataataaataaatctgttttattttgttttccctaaaaattgaggctcttccattttaaatctctcctgtgcaatgggcatgcttccctcctacattgcaggttgggaaacaaagacacagaggaaatgggtggcttgcccaaagtcacccaaaaactctgtcagagagagaactcagactaaaacctaaatctgcccctaactccaacccccattcgtaaagaccccagtctccaagtcaacagaggcaagagatcccaggtccatcatgagtcaggacaggcggctcatgtggggaaaaggatgcattctttgtttttgctcctggctcagatttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatggaatgaatgatctagatcttcaacaataggctcatttttccaatttccaacgcgaactgctgaagagggccctgcacctgtcagaatgcaaagcccatttgtcagttcctggatagtttctttcagctatttcaaggggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccccgagatgttaacctctgtgtgtcaatgaagcagggaaactggacagttggttcacttttctaaatgcaggagcaagatgagggaaattattgatttgtatcaaaacagacaagaagcaaatagaagagaagaccatgggcagggaagggtttgaatacaaatggaaaccaccaggcatagcattgggagcttctgaactaagtttcaggtcagaggtacctgcgtcaccacagcatggaaaaacgtaagggagaattcttggctcaccatctccattggaactcctttaccctgaaagtgctttttccagtgtctcctgttgctatggtaattagaggtattcctggctgggatcttgatgatggtgaataagcaaacaaacatacaacctcatttcatctggttttaagggttaacaagcaaataaatgcaagctaaggtgatagggtatgacaagggaggggaggggctcttggagactgactcggtcaaacagacacctgaaaagtccagggacgagctgaagaatcccctgagactgggagaaaggaagactgttggtccttggtttcatcaaattcttcaatgtatttcctcctatcatccccttaaggttaagagtatctgcaagagagaatggttagagaaggccactctgaggaagcagcatctgagctgaggcctgaattataagaaatcagccccctggagactgcagagggtttggaaaagggaagagggaaagcaaggctaagcccatctaagacacaaagaggtcaaacagcacaagccagatgtggtcaagagaatctgggggacaaacaaaagaagagacatttttaagcaggttcatggaggggatagatgacgaattaggatttttaaatggatttctaagcattaatcccctcaggtttaataaagacaagaaggttgttgctgttgttgtcgttggtggtggtggtggtgttttggtcaagatattgtgaagaagaccagccctttcaggctacagtaacacaacttccaaggagggcttgggtacaagtgagcaaaggaaggaggggtccaaaccagtctattcactcccagtcataatgaaacttccccaaacacataaatcacccaaggtcccagtcatctaataacacctctgatctcccagtgtatgctatgcttataatgtttgtgattcttgcacttacattttccaaagccctcatcccctttcctttgagtgggtccccctatatcctcagtatgctttttcaatgcaagggataaatgacccccttaacactagcttccatttaaagaggggatagagaagtaaggcttatgggatctatgtgggatcatcaatgagtctaagataataacagagggatttgcagggaggtagagaaataaactaggagagctagaagggcattgaccaagagtgagcaaagaggtaaaacaatagatcaaggaagaaaaggaataggaggaataaaaagaaagcaggcagagggtggcaaaaaaaaaaaaaaaaaaaaaaaaaaaagaaagaaagaagtaagagggaagagaacagaaggaaacagagaaaggaggatttggaaagtaaagaaactaaggagaaagaagtatggaaataaaataataaaagaatgggataagttgaatgtcagaaagagaagatgcgagccaaccaagaaaatgacagagttacgtagggtggaagggcatctccaacaattaccccaacctgcatcataacctgcctctttcaccttccagagggagcagacctcattctcttctaccacattgcattgcgtgaaaccactgctgacactccctcccacgatgcaggctccctgggctcccctgagcagctattctttcagactcaggcacgcatgaaaattgagttcagctaaatgcaaactgaactccagaagacctgctcctacccatcactgtaatcgttaagggagaaaattaattgcctgaggccagagtgtcgaaatccaactagacatctcctcccaagtgacctgtccctgagcagattgtggtgggcacacctgtaagtaatattccaacttcatttgtctacacataatttcccttgtcaggatttataatcatatacacatagctgttgtggtttttatggagtttctgtctttcccaatacaccataagctccaccaatgggaagaggctatacctattttttaacactacagcacctagcacatagactaatcactcatcaaaaattctcaatgatggagagatgaataggggtggggatttcaaaccaggactcacagttcttaacaaagaaaacagaataaaaataaaatgttcatttttctggtctgattcctctaacaccaggtgtttttttaaatcataaaattatctctcacatattaagtagctaattgctatgacatttcaaacaaaaaaacgccaacctttacacaacttaagtcatgctctttcgttcctttaaggaaaccatgatttttttcatcatcaccagcccaaaaatgtatcatcctgacaacacagaagaaaaaacaacttgattaatcttggaaaatttcctccaaaatcgaaacactgattgctgagttaaaactcaaaacaggagctctgtcctgaactggcctgtagactttctaacactggaacaaaccagtaatcactagtgttggagatgctataattgaagtcagcttatgacaacagggaaaaggctgagtctaaaagctctcaccattcaacactccccactcccaatgttcccactccaaatggtacagtaatggtgtgatgataggtccatccagattctatcccgggggatctcttcctgtgtgtagccttccccctacactttttcttggtatcattgatctccttctgtttttcctttcttttcatgttttctttcaatttgattcatttatatacacatatgaatatattctcctttgataaatccaaacattaagagacaaagctaaagccctcttgactgccatccctaatctcaactcatccccaacatcgaccattcttgtgttacatgtttgttgtgtatccactcaaacctctgtctatgcattgatgtgctaatatggtctggctgtgtccccacccaaatttcatcttgaatcatagctcccataatcccacatgtcatgggagggacccagtgggaggtaagtgaatcatggaggtgggtttttcctgtgctattctcatgatagtgaataagtctcacaagatctgatggttttataaagggcagttcccttgcacatgctctcttgcctgccaccatgtaagacatgcctttgttcctgctttaccttccaccatgattgtgaggcctccccagccatgtggaaatgtgagtccattaaacctctttttctttgtaaattacccagtcttgggtatttcttcatagcagtatgaaaatagactaatacatgtacctactacatttatttatagaattataacacctcattccataactttttacacaaataataggttatgctttttgttctataactgtctgtttttacccaaaaacatgtcttggagacctctccataccagtatgaggctctactttattctactagatgaatctttcccatggtgctcatgtgtcatgggttagccatggcactgcgattgatatttagtccatatctgttgttatataagagtggcatgaacctcgaaaacgtcatgataaacgacaggagccaggcataacactgtatgattccattcacataaaatgtccagaataggcaaatccatagagacagaaattagattattggttgccagggagctggaaggatggggcatgttgtgtgaatacttaatagatacagaattttcatttggagtcatgaaaatgttttggaagtagagatcgaaggtccttgcacaacattgtgaatgtacttaatgtcactgaattgtactctttaaaatggttaaaatagtaaactctatgttatgggcactttactgcaataaaaaacatagaactgccagatcacaaagtatgctctttaaatttttataaaaattggcaaattgccttgcaaaatcttactccctttatgtttttgtattactgtatatatctctatgtatctttctcaactaatttcagaatcagtctcactcttctctctctctctccttctccctccctccttttctctcccccttgccttcctctccaactctctaacagttctgacaatagtcacaaatactcctcctccccctcctgcaaaaacttttcaggtcatgtatcagtttcaattacatgcattgctttctccttcaggacttcctggatggcttgctgagggacataaacatcctaggggtgcgggtagggggtgtggaatatacaaagaatccttatttctttagtcagctcagagccaatggaagcattacatcagcagaacaaacaatattaaattagaggttccaacaactcacaattcctattatacaagtgtagtattttcctccaaacagcacagaaacttacactgaaagcagcttcccaggcacctgctggcccaagaaggatgttcttatgtcaaagagtttccagctatattagagaggtagtagagtcagtggttaagaatccaagttctggtatcagactgcctgggttcaaatcctgactcaactgcttaactcaagaagtgaccttggcatattaaacttaccactctaaacagcattttgtaatctctaaaatgaaggattgataagaatcaagctgtccatcaatgagactggataaagaaaatgtggcacatatacactatggaatactatgcagccataaaaaaggatgagttcatgtcttttgtagggacatggatgaagctagaaaccatcattctcagcaaactaacacaagaacagaaaaccaaacactgcatgttctcactcataagtgggagttgaacaattagaacacatggacacagaaaggggaacatcacacactgggcctgtcaggggttgggggctaggggagggatagcattaggagaaacacctaatgtaggtgacaggttgatgagcgcagcagaccaccatcacatgggcatacctctttaacaaaactgcacattctgcacatgtaccccagaactgaaagtatatatataaaaaagaaaagaatcaagcaagatacggaggctaatcactgatcacaggctctcacacagggggtattagtttccatttgctgttgtaacaaattccacaagcacaacgacttagaataacacacaattattattctgcaattctgaggtcataaattctaaatgggctcactaggctaaaaatcaaagtatggacaaagctgtgttcctccagaactctaggaaagattccatgtctttgcctttccaggttccagggagttcctgcattcctcccctgagcaccctcattattccacctctgtttcctctaccttcactatacatctcctcctctgactctctccctcctgcctcctttcttcccttataaggacccagtattattacactgggttgacctgaatagtccaggataatctccccatttcaagagccttaacttaatcacagttgtaaaatctcttttgccaaattaggcaacacatccactggttccaagcattagggcatggacacatttggtgagtccttctcgtaccacatgtgaagaacatgcatgtgttaaccactgcggctatttctacactactcctactattacagagaaagaaagtttttttttctcctcctaaaaggaaaataagtagcagtcatgtctcagctatcaagagaaagggtaaaaacctataccctcattccttgaaattcctctaaaattacttaatatattgcttttcttccaccagtgggccacttgttggaagtcctaagcagtgagttatgttctaaagcactattaatagtctatagagtcctttaaggtactttagcatggaataagggaggaaacagaggagagagaacagtgttctgggtaccttggcctaccggatctacactgatttcattgtattaaggaagacaaaaaaacaaagattcttccctatccatcatgcttctttggttttggacagcaccttgtaaatatcattttcctctttctcctttttcttctcttccgctgctgtcttcatttatttatttttctatttctccagaaatgggtgcaatactgcatatcttcagcttcttcagttttgtactcccattactttggtcctagtcttggttatactcaaagggcagatttcacaaatgaactctagactcctcctgggcccaggaagtttgtcctgcttaccatggccataatctgtaggcaatgactctccatccctgagacccattaatttaactaggatgataaacagaaaaataaataaaggtgttgtgatatggggaagaaaagcagcatactgaggtcagcctaccttacccgtgggccccaattgtcctgggcaagttacttttcctttcttcgcctcagtttccttatctgtaacatcagaggctgagcaggatgatcttgtgggtctcttcaaactctgagattctatgagtctatacaaagagtgtttatccaaaccaagaacagaggagaagaaatggcaccaatattggaaccatgaagtcctgggtttaaattgtggctctattatctactacctgggtgcatctatcaggtaggattcacctggttgcaagtgacagaaaattcaaaccatcttaaacaatagagatacataagcttctgtgactggaatgaccagtggcaaagatggcttcaggagttttcaagtcagtagaccaatgatgtcatcaagattttgctccttccaactctctgccctacataccctctgctgaaactatcttatggctgatgccccatcgtgaacacaacatgggaacctgccaacattccacaagtgcttccatgcatgctcttgtatctttagaaggttctcagaagccctccaataaaatctcccatctcatcgttcttaactatgattcatgctaatcaatgagccagtcaccatggccagtgaatcagaattgcatggattggcttaagcctgagtcacatggcctgcttttaccaaaggacatgaaattcatggggtaggcacggatatccaacgggaaattatggcagttaccataagaaaaaagagcaaatttgaggagagacaaataaaatgtccaccacaacggcctttgagaatatatttaacttctcttagtttcagtttactcattgataaaccaggataacacctacctttaattaggattagatgcagggatatttatcaatcattcattctggcatttagtttaccctggcagcatttttctaataaaatgtagctactaatatcatcattattatcagcaccattaccactagagaaaaagctatagaaactaacacagcttcctttggctcttaccaggtgaaccttgagaaatctctgagatggcctcatgtatcacactagagcttgcaaatggcataaaataatcagataaaacaaggtacaagatgaggaggcatcaggttccttaatgctttaacatcagctcagtgcaaatggtgaactgatagttcctctgagcccttggaaatacaatggaaatcaagttttggagaaacagaataatcaaaatgggttattgccaatagatctccaactaagggacaagaagacataatagatgaaacacctaatctgtggaatacattcccctagggagagctgaccacagatggaatggctattcaggaaggcaatgagaaattcatctctggaggctgaatgaccggtttcacggattaggtgggtaagagaaggaagtcagtgtagtcatctataggtaccttcctcacagtaagcctggaactccatgagagaagttggaaactgagatgcctacagaaagcacgcaggcaacaaaattgagcaaagtagggtgtgtagagtgtgagatgagcgaagggttaccaccttatcccaaggggcaatgactacacaactccagcttctgtggtctgtggccatagaagaatacaacttgatgttgccagctctttcagtatttcaagacaatccagaattcaggattttgtgttaaaatcttcctattttaacagttggtaaaccatgcacatttaagattttgtgtaggacacatttgtgaacgagagtcacccaatggactttggagaaaggcatttcatggcctttaggagaaaggcaattttcctactggaaaccataaggccttttattcttgtcgaaattcatcagtactttgtaaaatggaataaacttttaagcattaactagcagaaaaatctgccatattgctgctgagtgagtgtgtagcaactgacaattatggacagtagaactcaaactagctcttgatgcatgggaagcgaatacgaggcaatcagtttaaaattagaaccacatttcttagaggcctccatctgtcttcctacatggggagtatggagtccctgatccttcatctatttttgagtggccctgtccagatgaagagcagaaacagaaatcctggattctgattccaatgggagaggcatggaatggtcaaaagggtggtagaagaaagagaaaaacccatgtggaaagtgttcacagcagtaattaccataaaggattccagataagatatctattatgcaggaaaaggaaaagacatcaagattagctagggataattaaagaacaaagttagtgaattcaggaaaaagctggataggcctgctaaaagattaataaaaagagaaaaaacgaacagagatgaccatggtattgtttgcattattttggatatggaaggcaggaaaccaagaacacagtgggagtataccaagtagagctgagttcttggacaaggctgaaattgtgcacactcccacttctggttgccttagcaatgagactcccactttatacgaatgacatgagaatgagtaaaaccttatgcaaatgaagcacacagtaattagaggcagagccacatggagtctagatgaggccatgtcggcagaatatctagggaatagtctgagtgggcttatgcagcaaagaatgaggtcattaaagcaaagacactgagctatgagtaagaggaataagtgcttgagaaagactgtgggttccacagacttgttggttctcccactgattttggtcaagttatttcaggtaatggatcatgcagtcacacgtccgcattgcctcacctgctctattttactgtgtctctcctgggaagaaatcttggaaaagggtaagaaggttgtttactgtcctggttccctgtgtgtgctgcctctcactattacccatgaaagggaatcaaaagggggctgggaaagtttcacggagagggttgagaactcacaaataaagaggacaattaggcccggcatggtggctcacacctgtaatcccagcattttgggaggctgaggcgggcacatcacgaagtcaggagtttgagaccagcctggccaatatggtgaaaccccatctctactaaaaatacaaaaatcagctgggcatgatggtgcgcacctgtagtcccagctactcaggaggctgaggcaggagaatcgcttgaacccgggaggcagaggttacagtgagccgagatcacaccactgcactccagcctgggtgacagagcgagactccatctcaaaaaaaaaaaaggacaattatgggatgtttcttacggctgctgtaacaaattactacaaaccaggtggtttaaaacagtgtacatttattccttagagtcatggatgtcagaattcccaaatcagttgcactgggctaaaatcaaggtgtcagcaggggtgtattctctgtggacactctagggaagaatccaattccttgccttccccagttcctagaattgtaatcccagcattccttggttcatggccccttcctccatcttcaaagcaagaagcacagcattttcctttggtcatcaaactgtcatcttccctggtagtagaatctccctgtctttccctgatgaggacacttgtgattatattgttgggtccacttggataatacaggaaaatctccccatatcaagatgcttaacttaatcacattggcaaagccccttttgtcatgtaaggtaacatactcacaaggtcaaggaattagaatataagcattttgagggccctttattcagcctactacacggggcaagagagagtagaagtggaaaggaaagacaattttaagaattgttacttaaagtgcattataaattagatgcccatgaattttattgaaaagacaaaagtaaaacgaaaatttatttttataaaagctctgtgtttctctgaatttacaaagttttgaggctagaatatatggggcactggtaagtatgtaggttacaagcatgaatcaaataaaataatcatttgaaaaaattgcatctagcaacatgcatcaaagtaattagtttaagaaattacttctttgccagcacttattttaaataactattgatataaaaagtgacagcgaagatttagatatcagaagctacttatattctgggccaatgtacccttaaaagttgatttctctcctgctttctctcagacaactgctgtttatatttgtaagcttgtgcaattccacaaactaacaaacatgagtataacattttttattactcacattaactgctatttttcaatccaaaggaaaatgaaggagaaatttcagagcgatggtcacaaaaccaaattttataggggccaagtgtgtaccatgagtgagtgaagtggtccagatacgtaaagaggtaaactgggggggtccacgccctacctggagaaaaagatattactcacttccatctgaatactgccatttcaacagacagtatcactggagcttttaaatctttaagagaagtcaaatatccagaatttcatgtaacatctcctgatttgtaaatgttggagactaagtcaaagcaccatgtgggctgaataaaactcattcatcctgtggcctgtcactttgcaaattccattataaattctattaagtacttttcactttttaaacctaagacaaaaaggggaagttttcatccagtgaaatgacatgatcacatttgtgttgaatttatttctaatgcaaccacatatacacagtgacacacacatttacacaaacctctgagtgtatgaataaactacctttgaaaccataagttcttaagggatagctttttacctcaatattacagctttggccagcactgagcaaagactgttttcctttcagtgaagatctatgtaaggatgtaggctgttgtaataataacctacttcatataagagaaaataagctcccaaatacaatgtgattagcctcagtggtcaatctaagcacaattgtcccaggaacctggacaccatcctaactgcagtcgtagaagtcaccaactgtgctctcctggcccttggtcaggactgcaatgaaatcgtctcaggcaaaggtgcatgcacccagatttttaaacccagtttttttacaatgcaacttcaacatctgcatcaataaataaaccacgtgaacaaccaaaacgacttttttagacagtgagaagagctgtgtgcaagacaaaatgggccatgagatagagagtgctaagggggagcggtcaaggaggatctatcactcctaaagagatgacattctggctgtggctagaagaacccaatcatgtaaatttcattttatttcttaaaaaatgttatgggtacatagtgggtgtatatatttatggagtacatgagatattttggtacaggcatttaatgcataataatcgcatcagggtaaaatgaggtttccatcacctcaagcattcatcatttctttcaacgttcctattgtactccctcagttattctaaaatgtacgacaaattattgctgactacagtcaccctgttatgctatcaaacactagatcttacgcattccatcttaactatattttttacccattaaccctccctatttcccagcaccctctctcacaactacccttcccagactctagtaaccatccttctactctcttctgtgttcaattgttttaattttcagctcccacaaagaagtaaaaaacatgcaaagtttgtctttctatgcctggcttatttcacttaacatagtgaccttcagtttcatccatgttgttgcaaatgacaggatctcattctttttatggctaaatagtactccattgtgtatatgtaccacattttctttatgcattaatctgttgatgaacacttaggttgcttccaaatgttggctattatgaatagtgctgtaataaacatgggagtgcagatatctcttcaatatactgatttccccttctttgggtatatagttgacagcggaattgctggatcatatggtagttctatttttaatttttgaggaacctccatactgttatccatagtggctgtattaatttacatttctaccaaaaaagtacagggttccccttcctccacatcctccccagcattcatcattgcctgtcttttgtaaaaaagtcattttagctggagtgagataacttattgtagttttgaattttatttttctgaccattagtgatgttgatcatgttttcatagacctctttgccatttgtatgtcttcttttgagaaatatctattcagatcttttgccaatttttttaattggattattagatctttttcccattgagttgtttgagctccttaaatattctggttattaatcccttgccagatggatagtttttaaatattttctgccattctttgggttgtctcttcgctttcttgaccgtttgctgtgcagaagttttttaacctgatgtgatcccatttgcccattttgctttggttgcctgtgctgtcggggtccacgtaaattttaatttagggggctaaaagttctcggtaaagggaaatagaaaagcaaatggcctttgacaggaatgaacacatagatgtaagtgacaagaggctgtgtagctggagacagatttgaaaggaagaaaatatgattgacttggagacactgacatgggcagataagaacacaggaggactttagaatggaaggtcctaagcaggaaggacagtcttatttgtatctttaaaaaagcttactctgacaagtcattctacctctttgagcctctggtacatcctctataagatacaagtagtattctttttttcacagggctcttaagaaagttaaattcgatcttggacagaaagtacatggcatacagtaggcactctatgaacatgagctgaacttgaacatcttggggggaagtaataacaccacagagaggaggcagggaatgaaggtattggagatctgtcctcttgagccttgacggctcctgcttctaagagaggtcatgatcttatgacagtgccttccccaatccccttatttggatatcccatggctatgcaacagctgtgccccaactagtaccccatggtggcttccaacagcaaaactaatttggttgtgtcatgctgagatatccatcttctaatacaaatgtaacagattagcatacaaagaatggactgctgttgaccacagggagtagtaagactaactttaagaagcttgaacagcgtgcagtcactcccctactgctgttgttttgtagagcataagaagtgggtggagttgtttccaacaataacaatcaaaggaccaaagaccggacccatgagcactgtgattcttccctgagcatacaataaaccaactaggcaatgtttacccaaaacagcaacataatctcagaagcagcagttccacacataggtaacttcctataggtactcacacttttaggcagagatctgtgcaaggatgttcaaggcattttttgcatgtaatgtcaagagattaggaacaagctaggtgtccatcagaagggaattggtcacatccattagggtacattttcaccatggatgcacattccatgcaactgttagaaaacaaaactgatttacaggtaccaacaaataataatttgaaaaacatggcagtaaatgaagaaagcaaggtgtagaacagagcacagagttggctaccatttgtgaataaaaagtagtatatttatttgttgggtctttttggtgccagacattggagatttagcagtaaacaaaacaagccctggctccatttagcttacactctgatggagagagacaggcaatacactaatacagatgaaaatacgttatatgtcaagtgctgataaagtcccgtatttatgctggaatttgggtgaatcatgtcaatttgctggtaagtgaccactttgatccataaagaaggtgattttgaaaggcttagccaaatacatactcagacaaaatgatgtacaagaaacagcaattcctccaggaaggaagcttagaagaaaaaatacttgctagacacatacagatgctgatttaatttttgtaatcccatgtgggtattgcctattcaaaacaaataaatatttttaaaaatgtaatcatagaaacacaatagagttgacacacagagaggtagaaggtaggtaaggatgaagtgaggattaggagctaagaagaggtgaattttttcaatgcaaaagtaggcaggtgagagcgacatactgtaatagagtatgcgccactcgaaaccataagtgcccttttatttgtgattcggctcaattcccaaggacggcacaacccctagactcagaccaggaaaggcagtggtaacaaacagggagacctggacaggatgggggttgcaatagagtctgtgcctgagctcacctgggcacccaccccacatgttcctcaagggtcttgcttgcagggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagacaaaccagacagaaagaagtcacgtgggaccacaatgaacaagaggcagagacaggccggatgatggccaaatgcacaatgaaactggaactgaggttcctaaagatgctggcacagcgttgcacagtcacttgtcttgggccagaccaaagcacagtcccctctactctacgagtgaggagcaaggcccaaagaaacaagcacgactgtgaattctgtttgaattcctgctttctactccctagtactgtgccctcaggcacatagatgaacatctcagttcctttctcctttctgataagggtagagaacagcaaggcctacctggttctttccttattttattattatcaagctgttcatttcagcacatatatctagcttttactttgtacactaatacaagaagaatcctcacctaggtgagtttccacagccttatttttcttagtcctccagagttttcaagagaaccttattccacagacaggaaaaataactaatgggtactaggcttaatacctgggcgctgaaataatctttactacaaacccttgggatatcagtttacctgtataacaaacttgcacatgaaccctcgaacttaatataaaagttttaaaaggataacatttggaacctggagagcattagcaatagtacctacctgtaaaaatgttgtaaaattaaataagatcatgtataggaactgtttaatatacttcatagtactttataggtacttcataggttcataaatgcttcccaccgttattattgcactgtgaatactatggatttgcagcattaacaagtgatgactaggactcagctcagagaggaggagaggagaggctactgaaggttcatgcctccacccccaggtacgtgctgaaaaaggaatatctccccttgctcctccagaattcttaccttgtctctccagggaggccatgtatttatactgcactggtctcttcaccaggactgctatgctgcacaactccagggggcagcaatcatattatatcctgtgagcatagtcctccaccccacccttcacctgaagttgtggaacatggtgtccccatgtgctaaacgttcaggcttgctgggttattcctgtaacatttgttctatatcccagtccaacttttcatggtgacatccaaagttcccagccaccaatgccagactcttctttagcatcagtaaccccacaaacaactgggaagaatacttatctaccttccccactctttcttatttatgaatcagtttgaaattacacggtaatagttgtgcctgcattttgaagatggctcttatcagtaattacagatgtatgttaaactaagtttttaatgctaagattatcttcccaggtgtttacattagaaagaattctagatttggagataagtggagacaagttcacccctgaatatttagtaaggtgctaaggtacctgtgggattgcctgagttgtgactcttaagacattgcaagtaaaaagttacaactgacatcagcatccaaccattcttctgtaagtagcaatattctatttccttttgccttggtgggtccatcagtctacgtgtctactctcccagggccaaggcgggacccaaatcaaccactcattctccaaacatttccaacacaggaggaaaaacacaaggtcagggccgattcactgactgctgtgtgctgaagtaactgcctgtcagatcctccttcatggatccctagagaggctctccttattcattgcagatgcacgctttttgcagagcacccttgaaacatgctaattaattatttttttttaatctaagttacccagtgttggtttcatctacctgctgccctactgcagaatcagaaagtgggaatctgctttgtggcgggatgacgttcaccaagcatcgttcagggctggttcaccatgatgcctgtccaaacccctgagcacctagtgtctgtaccacacatgtaagtacttaatcacatgctacaccaagctgctcatagtttcaccctataactcttgtctctgcagacagacaaaagcttttctggaggctggagaccatagcatagataagaggtcctcaaaactaatggatcatgagcagctgtgaggtgtgatgcactaattagttaggatcccagtccaatcagtgatacttggaaatgattttggctttttttgtaagctacagcacattcaaggtcatttctataataacatcattcttactcatttacaatctgaaatgttttcttgagtgggagcgaaatggaaaaagtttttaatgtgttatgctttgtcttacatattctttaatcctgtacagaacagagcacagattcaatgttgaattgaactgattatgtgacatcctgcaaacaataaaagcatcacttttaaagaacttaaagttccttctcacaccttttatacctgatctccagcccctcaaagggttgtattaatgcatttaaccctcatatgctaaatttcatttctaattataggataaccacaggaaaaatggttatccagaccagccctttaactcaagaatcacaaatgcaacatctagcatggagaagcaggtaaagaaaataatgtaaaccttgttcaatcgattctaaaagggtggccatgtgggacaggcagaacaatggcccccaaaggtgtccatgtcctaatccctggaacctgtgaatatgttaccttacatggcaaaagggactttgcagatgtgattaaggtaaagatcttgagatggggagaaaggacatttgaaagtagagtctgagaaagatatttgaagatgccctggtgctgccttggaagatgaggaaggggccttgagccaaggaaatcaggcaaggaaaaagcagcttcttcccctagagcctccagaaagagttcagccctactaacaccttgattttagctccatgagacccatttcagctttctgacctgcagaactgtaggataataaatttgtattattttaagccagtaagtttgcggtaatttatttcagcaataggcaactaatacaccatgtatcaactgcaaacaattgttgcagttctagaaagctggcccaatttaccagttcttgggtgggaggcggtagaggagcagaaaagataacttttgagtactgagattaatacctgggagaggaaataatctgtacaacaaaccccagtgacacgtgtttacctatgtaacaaaccttcgcatgtacccccaaacctaaaataaaagtttcaaaaatctggattttaaaaagagatccatccctagatattttcgtgaatactcattggatttttacagcctctgaggtccagggtgtatctatgggctggattcagcccataggctgccctttttcctctgttcctctcccacgaaagccttccccttgctttatcctgaagaatggccatccagccttaagcatccacatgatggcagctgactgccttcctaatcatcatcccaataagtgagagctttaatatttcaaagggtctgctctcaagcacagctaatttctctctcccttatagcttttgcccacaggtcctactcttccctgcgggacagtaactagtggctcttgtttctcctccacaggacagcccttcgtatgtttgaagactgctctctcatgccctctgcctttcttcctgagaccttcctggaatcatagctcttctctctgtgctcattctgtctgacccttctaaaacgcaaagattggtaccaaccagcatcctcctgggtcaggagcaaggacagcgaaaccatgaccactgaagtgtttctttttaactacaaatcatctaaactctccttaaaattattcaatctttttccaggcaaagagattttctttggtgaagagaaaaattgcttaaagtggtttgacccacacctctctctctggcctccttcctcttcctagaaatccagctattgattcagcttctactcatgcctgtaatctcttgctcaagcgtcacttcctcaacgaagccgtctcagaccagctaccagtctgggtcaagctcctctgttgaatgatattttcctttagaacattcagctctgtctgtaattacacacagttactgtgacttcgttatttgatgcctgtgtccccgtctagattgataagctctgtgagagcagagtgcaagcctgtatagcctagcccagctaataaatgggtaggtggtgagttgtgagtgaatgtgtaggggagtctgacttgtcaatattctgctttattatcagaacaaatgaaaactccagtttttggtcattttcatatggctggataccttccccttctcaacctggcacttgtagaataaattttataacctaaatgcaagaccagtatgtatgtctcttaaaggataccttgacaactttaccctgcattctagtttagtaaaccatatttgaagcttgatttcattggccactatatgttcttttctcctggccttataaatgtacacatttcttagaaaactcgggtcttcattcattctacaaacatgtcttgagtggctactatgagccaggctcagagggtagctgaagataaataggtaaacaaagcatgagccccacccttagattactcagtctagcaggacagacagaggcataaatggaccactctgaaaccaagtgttgaatgccattataaagaaagttgggttctgtggtgtaagtaggagttaacgagatgaggatggcacaggagtcccagacaaagggaaactcattaccaagaaatgagggtgtctcaagaagtgacaaccgttttaagtcatttaaacataggtcagagtggagagagacaagcctagaaggccatgaacaaagagacttatgcagtgagttaagcaatatggactttatcaacaagtaatgggttattaataggaacatgacatttatatttcagaaaaaaaaatttagcatctacaggaggatgagtgaatagaaaagcaggaggacattagaaggttgttataatcatttaaataagaaataactggacaggtgtggtggctcatgcctgtaatcccagcactttgggaggccaaggtgggcagattacctgagatcaggagttcgggaccagcctggccaacatagtgaaatctcatctctactaaaagtacaaaaattagctgggcatggtggcacatgcctataatcccagctactcgggaggctgaggcagaagaatcacttgaaccgggaggcggaggtcgcagtgagctgagatcgcaccaccgcactccagcctgggcaacagagcaagacttcatctcaaaaaaaaaaaaaaaaaaagaaaaaaaaaaagaaaaagaaaggaaaggaaaagaaaaaaaagaaataactagaatcttactaagggtaggaggaaagaatagagaggaagaaaaagacttgaaagatccacaatgtctataaaacagatctaagtacagagacctgtggcctacctttggagacctacttccaggtgacttattttaactcagtgacacaacaactagttcactcaggcaaaataataacaaaaatatttttttcaaaaaaagactccctgattccgaatgcgctttaaatttctgaacatacttacatttggaaaatcattttgcaagataggcagtttgcactagattcatttgcatgtatataacattgcagtgtaagctttcttctaagcattttcacctgcttcatcacccattggctgcattcccccagcaaacatttattgggaacatactatttacgaggtgatggcaactgcaggggacagggaggtgcaacaactcagcccctgcaatgaggcaattcaccatcagtgtgggaaatggacagccacacagaacctcattaaaccatgtggtagggtagctgggcatagtggctcacactgtaatcccagctctttgggaggtcgaggtgggaggatcacctgaggtcagcctggccaacatgataaaaccccgtctctactaaaaatacaaaaattggttgggtgtgatggcaagtgcctgtaatctcagctactcaggaggctgagacaggagaattgcttgaacccaggaggtggaggttgcagtgagccaagatcatgccattgcactccagcctgggtgacaagagtgaaactccatctcaaaaaaaaaaaaaaaaaaaaaaaaagtggtaggcatggcctgagcacgggaaacccagggtaatgtaagaggcgcagagaagaggccccctaattcagcctgcaatggtgcagtggagtgggggacagtcaggaaagacactttggatacctgagcgttgtttggtttcccatgtagcctgtggacttctcatggtacatgtttcatctgtcaccccatccaacaatcagcacacagctcaaacaagatggggtcagatctccacttcatacacactggatttccacacatgcatgggaaagaaaagaaggactattgccccacagattcactgcatctagtattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtagttgtgtttttgcaatagtttctctcccccactgggtgattattcatgcactgcttctccacattagggcaaagtgagctcacatctctcttacctgctctctgggcctcccggcctggactcgcacaagggcaccatcccactacccctcatacttccaatcagtgcagaccagagccaccccaaccccactatcatcactcacatgagcagcaggatggagctggcacagaagacaagcctcctacacctcctctgccaaatcttcaaatatcatcagtcacactggaaaatggccccaggccactgctgcttaatgggccatgatggatgaacacagatctagagaaatgattgtttaccaactaagggatcagagcctatgggcctctttctgtcctctgaagagcatgctgctactggggcaaatgagtttgagtccagagccgacaatgagcaggtgatcaagccccaagtgaaatggcctacaagcccctcatcttctgaccacaaaaacaccataggaacatagagacactgccatttttttaaaaggaaccttatgaggaatacagacaaagaaacagataatcattacacattaagataatcattacacgattaatagataatcattacacgttgttaagtgctacaatggcagcatgatagggcacttgatgagtcttggtggggcggcagtcagagaagactacctgggggctggggatcatgaaagaaggcaggaggggaaatcatttctgcacaggttacagtagactgagtgcatgttctagagccaaacagccttggttgcatcttggtttgttcggcttatttcgagctatgttaattgcaagtcactactctctgagggtctctaagtgctctgagaaatatgaacagtaacagttcccagctattgtgagttgttgtgggggttgtacaaaagaacaagcataacataagaaaagcataagaatgagcctgagacactgtgagtactcagtatacattggtcatcataaccaggactgcaagtacagcaaggccaatgaagcacttcctttgggtgcaacatttaagagggtgataaatgactcatcagtcaagataagtaatattttaatatgatatttttacaaataaaaaccaatgcaaaaaaaatgatgcaaaacaaatcaaaatttaaataaagacaagatccgactgtacttgcccaaccttagtctcagccctgctggatcctctattattatgttaatcatggaattcttggcattaatttctattctctaaaatattgcactgaaatggtatttaccttgataacttaattgtttggcacccttttaaattttgcatccaaggagggattcttaatctcttcttccttgtcctggccctgatacgtggctttccaattttctacgatgagagtagttacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacataagagaagaaggtggggtttctgtgctagcaccagaagacacaaactggaggcagcaataccactgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccagtcactccccacacaccgtgcaccccagctccgctttcaccatgaagatgagcaggaaagaaaactcatctcccaacccgaggttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcacagtctggcatacagcagaggcacaataaatggaagatattgtcacaaggatagcaaggaggaaatgtttaatctgtaagcatttcaaagagggaagctaaaattgtatttctaagcagaaatttgtggacccattttaatgacaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatattatacacttgaaatttgtgaagcgattagatcttaattatactcacaccacatacacagacacccaaaatggtaaccaacagtcgtgaaagatgtgttaattaattcgatggtggtgatcatttcacagtctacacactcatcaaaacatcacattgtacaccttgaatacaaaccactttatttgtcagttaaacctcaataaagctggaaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtcccagctacttgagaggctcattgaaactctttgggctcagtttcttcatctggagaatgggaattctcatacctaacctacattatttttccattatttttccaagatgttcagaagtcaattgcataaaaaaccacctttcacaatgtagatgatcaataaatataaaagggagttctgcacgttattatttcaatacgaggtgggagtttagtgcagcaggctgcagctgtgtgtgcaataaatatagaattagaattttccacattgagtttctgaaaaactaaggagaacatgaactctggattcaagagagtcatactagctatacgatacaaggttaattgttctgattctcagctgcaaaatgaggataaataatcatggtgccacctatgatgttgtaaggacaagataaaagtaagtacatataaagcaccaagcatagtgcttggcccatgttaagagctcaataaaaagcattattttactataattatgatcatcattattatcattgctactcccctgccaggtttagcaggggtcctacctgtaccagctccaacataaagagccacaggacagtctggacagacaactgagatgctgtacgtcttggtcaggcccttgcacttctccagcctgtgcatgatgtcaccacttccccaaacttctccctctcacctccaagtttgtgctaaaccgcttaccaagcagcttcagactcattaacatctaatcagccctaattggctgcaattcagcagaagtcctttcagggggcaggtgactggcagaatccccagaagcaagcccacagcctttggagagcagtcactgggtgggtgggagagggaagaccacagctgggtcccctaagcagcctgtaccttcccagctctaaggcagccatgagacctaggtagtgaatgaatggactggtcaatgacggctctattcaacacatatttattgaacatctatgttgtgtcagactctgccctcctggaatccctcctggatggccctgtgaggggaatctactattgttcccattttatagcagaggaaaatgacgcccagaaaggtgaagggcttgcccaatatcccagcagctggtaagtgttggagccagaattctcacctcagcagtctaccgcagactccaagctcttcgccactcagtgaactgtgatacattcccccagttaccaatggtagactttgaaaaaggaaataaaaaaggaagctgaaatccacattgacagcaaagataggcaggaggggattgacaggagcggaagcaagccctttctcaggagatgatgcataatgatgagaaatagccagccaagggagggaatgaggggaagagcattccaggtggaaagaaaagcatatgcaaatgccccaaagcaggggagaccttggggttgtctcccctgtcaggggagacagggtcagtggggctggagcaaatgaggaggctgccaaagtcaatgtccatcaagcccgttcaggacactctgagtgaccttaggctgcattctgccccatctgcctaacttctcttctcagtggactctctgcccccagtgatggggatcatcatgctgtgttaccttgggcaagtcgcttcacctctctgagcctcagttttctcattagtaaaatgagagtaatggtcataatacctatctcataatacctcatacagaacaccttgctgttcctccatgtcccaccttgacacctctagaaatctcttccctctgtctagaatgtctttccctatccccttcacctgtggaggttttactgtgattatgaggcacacatcaaaataccacagcatccaacatatagcaggtgcttgataaatatgtgttgaataagtgaatacaaactccctagcagaatagaatgcaagccttgatttccagctcagccttacacacacatacacatgcatgcacagagtcacacacatgcatatgtgcatgcacatattcacacacacacgcacacacgcaagcacgcacatacgtgtaccatcccagccacacagaacatcttgctgttcctccatgtcccaccttgacatgtctacaaatctcttccttctgtctagaatgtcttccccatctccttcacctgtggaggtttagcctcgctttaaagtccagcactgatgctagtttcattttcctctacatccctacaacatttcataaacaaaaataaaacatacatcagtgctgcaccatagtctatttcccaccctctcttccctcacctcagactgagtgcttccccatagcaggtcttattcttctctccagtctgaacacttagcacacagttgacattttgaggatgataaataagtatttagtgactgaatgagtgaatgaataccttggaactgtttttccataaatatatattcccacagttctcttcctatcagtcaatgaacaaccacttaataagaccccgtttcttttgagtattatgccagctctttgggagaaaaatgccaacaatgacactgttctcaagaactgaaaatgtggtctaagaacggcaccactagaaagtactacacatgcataatcagtatgactaccacacctggtattccaatgtctaccagggataaactgctcagtttgtagattaacacaggaatctaaaggagaaaatcctactaatcagggggatatagcttaactttcttgcttaaacaacccgagatgatcagccagacttcccaagcctgtaaaaagagggctctaccaatgagaaattaaccacctggtattgagatggtagattccgactgagtccactcaggctgatcttagaccgagttggcaacaaacaaaaagagggccacagctgcccccaatgttcagctgcattcccaagctagagaacgagacacttccaaatctgaaataactcatccaactgaggcagggctctataaacaacagacaagtaaaatacattgaataaatattacataatctattttctttagtggttgtgtctgtatatatgtgggtacattcaggtgtggtttttacaatgacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggtgatgaaagaaatagatgtgaaggaattaaaacaccaaaaagagccttggtatttcctctcatcttggttcaataacctcttgtgagaaaaaagttttcagtgcgtgtcgctataaatgagcatgattggcttgccagttgaacctacaaacagaaataatgtgagaggtcacaagtccactcatttgcactggacttccaaagagttttgtcatgcagtgtctcagttaatcccccaatagcccagggaggtggacatgggcaccattttacatacagagaaaacatcccaaaacattgcagtgatgacacatatttattaagcataaaccttaggccaggtacatcacacattatgccatttaatccaccccataaactgtcattgtgcctcttgttcagaagaacaggttggggcttagagaggttaaatgactcatccgaggtcatatagcttgtcctcagagccagaattcgaatccaaagacatgttcttaagaaccatggcattcacctctccctaggacacacaagggctcaaatcgagcccatgaggcttctatcagctatctaccagttcatttggatttttggctcattgcagactaatgatgcacaagtggtctcattaatggtatgcatgtttgtttgtttgtttgtttgagacggagcctcgctctgtcacccaggctggagtgcagtggcaccatcttggctcactgcagcctccacctcctgggtcaagcaattcttctgcctcagcctcctgagtagctgggattacaggtgtgtgccaccacacccagctaattttatttttagtagagatggggtttcaccatgttagccaagctggtctcaaactcccaacctcatgatccacccgtcttggcctcccaaagtgctggaattacaggcgtgagccaacgtgcccagccaatgtcacgcacagttttaagcaaaactatgtttcagtctcagctaaactatgtcattaccacgtcttctctgtctcccattgccgcttagagatcacaagatatgccaagatgggtctggcttttagagactctcattttgcagacccattcaagccatggatttagtgtagtgtcaagatgagaagcctaaacaacatagagaaagcccacgttcagccataacttcccactcactcctcactgaagaggtaggcacaatagctttctcactgcttagcaattatatcaagtaagagctgttggatggcatgagagaccacaagtagacacagaatggctatttggttggctggctgctcattttttgagcaaataaaataagcactaaattcaaaacagagcctcccacaaaataatccaaaatttaaatgaattttttaaaaaaagcatagttgaaatggagataagtcatggaagagtcagagaggagagaaaagaagagggaagggaggaagagggaagagaggatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactatcatgcttataggaaactcgtggctctggggtttaacgaaaggttttatatttttaatttgccagatcagggacgcagcagggtcttttttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctgactattttttcttttttttggagggacagggtctccctgtgttccccaggctggtcttgaactcctaggcttaagtgatcctcctgcctcggcctccctaagtgctggaattataggcgtgaatcaccatgcctgacacagcagaacctttgagatatatttaagcaaggaggctggaataccacctcatttgactccagggaaaatataactttttcccagagatgaaaataaagacaccagagcggggtccactcaaggatactgatgtgagccatcccctgcctccctatatcggctggcagagacaggcaggctaggggatgcaaaatctcatgggtagagatgcagccttgcttcagagaaatcttactgcaaaccctggaggccagactttagacaggattgcaatgaccttatgtatccgaggcagtggaagtttcctctaaagaaaaaatgggaggcaagtggcttgaggaagtcaggcacagcgagcttcgtagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccactttgacacatgactgcttggagattgagagccaaattcaaatcccaacttaggttctcactaattggatgagttggggcaagtcacgtcaccttcctaagcctcagtttgctcctctgtataacaagagtaataaaaagtagcttcctcatggtattattgtgaaaaataaaataaaatgcttggtgcactgtccagcatgtacagggaatctattgctattatttattattgttactaacagcattagatgcatttcctttctctgcatcttgaaggtagtctatgcaaagtacccagcatagcctgtaggatatctccaggccattagagagagaaaaaagaaagtccttcctaaatttaaacttcatatcacttcgccctctgatttaagcagggcattaggttcatctctaactctccctttctgtcaactgaagaacatggatctgctccattcactgcacagtcaagctggggggcactgcagagaacaaggaaagaagaccaccaccagcagacatgggccatggcagctcttaacaatggccccaggaaagcctagtagctccactcagtgagaaacacgccaaacaagaaccaggtctgcttttctctcacttcctcccaccccaaaacaatgcagaacttgaaatcaggtgctttcagattcaggtgaacgaacctcaggaagaactgcacttccagtcccctctctttctcaatcacagaaacgatcaagttctctcctattccacctgcctgttctcaagtggaccctcccgtgaagatggctctatttcaaatcaaaaccccatcgcaccaccacccaagggcttccttttgcctttccctaatccactttttgcctagtgcttattatcagctgacacattaaatatttgttatgtttctgttggcctctcctcacacaaagaagacaggtttgttgactgctgtatctccagcatgcacagcccattgaaggctcaagtagcatttgttacatgagaaaataagttgtttatagccctccccaacacctagcatccacataaagtgtaagggatcttataaaggagttgcccatattacagatgaggaaactgaggctcagagagaacagacttttccaagctctcacagcaaagtttagcatctcagctatcaagacaacccaagtattaacgttagaatatagtgaatgtccccccctgccagtgctccaaggaacgttcatcctgccttgtttcagaagcaacatccacagccacagcgtcataggagcctggctgcccatcctgggtctgcatttactagctgagtgaggttggtgtgtctctcagtgattccatctagccatatgcaaaataagatgacaaatcctgctcttactaccttccagtgctgctctggacatcgatggaatattttggaaacatccttggcttctgatgatggaaggggaacccagtgagacatgaggagtcctcgctggtgagtgctggagttggtgagctttcagcatgggctggcctggtgcctctgcgacttcccatccacaagctgtccctacccttactcgtcacaagcaaggcaatgttgatgcagtaaaggactaaaccagagatgatgctgcacccaccaaccaagtgcttcctctgccctgcgtgctcctcctctctcctccctcgtccaaggcattccgaaaagcacccttgtcttttgggcagagttccctttccaccctcgagctgtccccactgccttagcctggactaatctctccagggaacctctcctacatccacctggcttctcacagaacagtgcgggaggttggggacttattacaaagtgctctgaaggatgttgccgagtgcctctggtttttgtctagtcactgaaaatgccgacatcatccttgatcagtgacacatgttctacatatgccccacgccaggtctgtgttgagcagtaaataatatgtcacttactgcttgcagcaactctatgaggcaggaactgtgattgtgcccatttcaaagacgagcaacctgggacacacagagtgttttgttaaattcccccaagtttcacagtcagtaagtggcacagccatgattcaaatgcaggtatctggcatagtagggaaagagcatggtggtgatggctacaggtccaaaatgaatgtgtgctcccatttacacagtgtggcactgtcgctgggaggcagctgcccagccatggacacttcccagcacctctgcatctgggtgtagccatgtgactcgttcatccaacaggatgtgggccagagttttggagagataggacaccctttcttctctccttcctgcttcctggattttctggctgcttgcagaaaatcctaagttattagaagatggcagagccacaagatagtggagactgacttcttaaatccccacatgaagagaagctgcctgctgaccccaggaatacccaccattggaccatcaggttagcaaaaagtaagctttattgttaagccagaggtcagcaaacttttctgtaaagagctagagagtaaatattttgagctttgcaggccatgcagtctctctcacaatggctcaactctgttatcatagcataaaagcttccttagatgatctgtaaacaaatgggtgtggctgtgttccaataaaactttattcacaaaaacaaacaagggcccaaattgggctggagaaccacagcttgtcaaatcttgtgctaaggcattaaaattttgcaggaattatttgttattatagctaatgttaatcaagtaatataggaaagggggagtcctctttggtttccttcttagtctcctaataatccacaaccaaatgcagagggatctcactttcccaactctctcatttctccccagagctggagtggccctctttctgtccccactgaatccatttatctatggaaaattgggagagagagtctacaagaagagcactatacctccccaccccaattgcacacacttttttttttttcttttcagacagagtttcgctcttgttgcccaggctggagtgcaatggcacaatcttggctcaccgcaacctccgccttccaggttcaagggattctcctgcctcagcctcccaagtagctggaattacaggcatgcaccacccacacgtggcaaatttttgtatttttagcagagagggtttctccatgttggtcaggctggcctcaaaccccttaggtcaggtgatcctcccgcctcggcctcccgaagtgctgggattagaggcgtaaaggctgcagtcacgtagactcaaaagaaaaacagtattttaaaaaaaagaacaagaatgctgtataaaacagtaaacagtaaaacataatgcagcaattaaaagttaatgccccaacatttattttggggatacggcatatgtctcacctagtctgggactaaaaagtttcctgccttattcatgcaggggcttcttcatggtttgcgtaaggcagccaattaaagtagaaactcagacctggcacaatgctcacgcctgtaatcccagcactttgggaggccgaagggggtgtagatcacctgaggtctggagttcgagaccagcctggccaacatggtaaaaccccgtctctactaaaaatacaaaaattagccaggtgtggtgctgcatgcctgtaatcccagctactcaggaggctgagacaggagaattgcttgaacccgggaggcagaggttgcagtgagctgagattgcactactgcactctagcctgggccacagagtgagactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttaaaaaaaaatcattaaatgttatacaactctcatttctctcgtccttcaatattactgcatttctctcatcattcaatattactgtcagttctggcagaaaatataatatacccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgcctgcacttactgttgccctgggggtgaagatgctacctgaaaacccacatatcctggaaaggtctcacacaaggatcaggcgttttcagacagaaaggttttcttgttgatgttttctactgcattctctcttaagctcaagactttttattttgtgttttttacattgatgagttataaaggggtctctctcatctttcccttctttttaccttcttctttgctgaatctctgctctctggccaggagtcattacatagaaacttaagtgcagggtgatcatctattaactcagcaaatagttatcgacagctacaatctcagatactatttaaggcttcagagatacagcagtgagcaaaattgctgtcaaagtgcccacattctagtggaaaaagcaataaatagatgtattatttgttgccctaaaaaagtgaaaagtgaagcttctttggtatgtctcatgcaccatctagggggtaggctctgccatactggctgctgacttgttaaaaatactactatcatgaggccagggagaaatctgaactcgggaaagtggtgtgggggccagaatttgagaagagaagaagcctacgctggaatcgcacttagttcacgtcacttcccagatctggcttccaatggcctcttctcaccctctaaataaaatacgtaaatcctcaatgtggcctttacaatctgcctcttttaatccttctctgcagccacaatgacttctatgatggtcttccaataccctgagcctgttcccacctcagggtctttgccattgctgtgctgccccctggaaagcccttcccccagatactcacatgggtgtcccttcacttcaaatgtcagcacaagaggtttttcctgcctaaatggcagccaatatgctctagtctctcgccctgcttttaagtatttcttcccagccacactgcttcctgccacattcattcacttgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaactgtaacttactgcctgcactcctctcccctgcagccagttctccacgtggccaccagaggatgcttctggaaggtaaatctcatgttcaccaccatccaccctggctttaaaatctttagtggtttctttctgctcttatagcaaagatgcaacacccaaatgtggcctgagggtctcagcacggttctgctctgacctccttcactcttaccctccaagcaccagggtcttctcaggcaatttttttcagaccagacatttgctatgatccctccggccacagggcctatgcccagtctctttccacttcctgcaatgcttttcccttccctctgtcacccaccctagtcttcacatctcagtttcagcccatgtcctcagggaaccttctctgaccttcctgggtgggtcacacagtacttattacagcgcatcgtatttacttgcatgatacttttttgaaatatgtccctccttctctagactgtcagattcacatgagcagaaacagcacctggttttggaccccattttatgctgagcctagcatatagtaggctttcaagaaatccatgaacaaataactaaagagctgtgaccttcaaacaagctacttcaagcttgttgagccttgggtaacgatggctatgccagagagacatgggagacttcaatgacataaaatggatgatattttataaacaacaattggcgcacactgtacaaattaagtgattttttttaaatgtgggtctacccacctctaagcctttcatctaatttgataccttccacagagataccttgatctaaatgccacctctgctgagtttcttttagcgccttttgcattatgaaaagtcagtatctcattgaatcttctcatcaaaacagccagacatttaccatgtgttccaagtgctttatataaattaactttcagcccttgcaacccaccttcaaaggtaaatactatcattatccccatttcacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttaaccaatggagagtttcttgtgtccatatatccagtgtccttacccagtggagagtttctcgaacccatgactacaccatgcttttaagcacaccaggctcctaggataccacaggtgccccagctggtttgcacctgtgggcaaagtttgccctgcattcctgggcacgtgattatacctatattggggtgaatttctgtgactttcccagatgcatgtatctgacacccccacctaccaaccgtgaactgttataattccatcaacatttgccaagcaagattgtaccacatggaactctgcagtgagcagaggttacagagtgaggctttggccaaataggtctgggttcaaatcattcattcattcattttgttaacaaacactgtagagctttggctgtatgatgggcctgtgttaccaactcaggataccaaggtaaacccaggaaacacaggtgccgctatcagaaacccagagcctggaggggtagacagacactaaacacaacaacaagcaagaaaattggcaattgtgatacaagctacgatgaaaataaacaggatgatgtgatgaaacaaaactgagagtgaggggttagaacagggccatgatcttctccccatcaagctaaatgtgtttgggcaagtctcgtaatccctccaaacctgtttccaaatctgttcatggtgatggttaatctcaaggcacatataaaatgctcagaaatgaaagctatgcctttctggaacccaggcaccaggcattcaggtgtgaacaaagctatccatgcagtccgggaggggagccagagagaagcaagcatgtgcgaccagcattaaaggggcagctgcagtcagtcctctctggagccctgtccttgttcttcccaacacagccttgtgcgtatgctgatgctgcatgaaatccctgcttcttcatcgttcgtcacaagaggtaagttccccagctccatcccagcccagcagccaaccataggaaaggcagctgagaagtgccttccttctcctgccttcttgggtcattgagcaaagaggagacagaggcacacgggcccactctctcttctttttttcctatcaaccgggccaaacaaccagcaaggaacacctgctgaaaggtgaagaggacagagccttggcagagattaatgccttcctgatgccaggcggccgtgagaactgagattggcagtgtgaaggtccaccttctctgcaaccaaatcataagtgtcccatagacaaaggctttgtgtttatctgccttcagactggtcagtgatcagggaagcttagcaacttggggcaaaactggctcagggccgggcatggtggctcatgcctgtaatcctagcacttcgggaggctgaggaaggctgatcacttgagaccagaagtgcgagaccatcttggccaatatggtgaaaccctatctctactaaaaatccaaaaaattagccggaatgttagcacatgcctatagtccctgctactcgggaggctgaggcaggagaagtgcttgaacccaggaggcggaggttgcagtgagccaagatcgtgtcactgcaccccaggctggacgataagagtgagaccccacgtcaaaaaaaagcaaaaaaaaaaaaaaaaaaaaaaaaaaaaactggctcagaactgatggagccacactttgagaaggatgttgacttgctggctaatgaatgattaaggtcaagaggtaaaggtgtcactcatctttaatagtcccaggtggaagaaaactggtctatctattcaggagacttactggtccttggctttcttaaagattccccaaatctagagttctcctgacattggtgtgacccctccactcatctcaagaaccactaggactttgcattttcagaaagcatggttgactgtctgcattcagtgatttgttggctgagacagtcctaataggtcagctaatttgaatatcacacatatacccaaattacacattgatactttagcctacagtaatctttctaaaactcttcagcggcccccattaaatataaactcatcctggctcacaaatcctttacaacatgacaacatctttgacttcatcttcactttcttttaacgtgtttagagacagggtctcgttctgtcacccaggctggagtgcagtggcaccatcacaactcactacagccttgaactcttgggctccagtgaacctcctgcctcaacctcttgagtagctgggactacaggcacacgtcaccacacctggctaatttttgtattttttgtagagacagggtcttgctatattgctcactctggtcttaaatgtcaagactcaagtgatcctcctgccttggcctctcaaaatgctgagattacagatgtgagccaccactccccacccatcctcactgcccaccatgtgtctgtacttcctttctctcaccctcctctccatataccctccaaactgtactgctcctctgaagaagtctcacacatctatatctccctgcctctgctccatttcaaatgtccttccctggctcctttcaaagcccttacctatccctcaaggcacatctcatgtgtcacctcccctgtgaagctctgcctgacttctccagggtctcacagaccctaggccaggggctttcaaacttgagtgtgcatgggcatcacccactggagtcaccgaccaggagatctcaggggaagcccaagaatctgcattcccaagtgatgctgatgctgctggtccagggaccacactttgagaaccactgcactggatgatcgatttttttttttttttttttgagatagggtctcactctgtcacccaggctggagtgcagtggtatgatcttggctcactgcaaactctgcctcctgggttcaagcaattctcatacctcagccttcccagtagctaggactacaggtgcttgccaccatgcctggctaatttttgtatttttagcagagacggggtttcaccatgttggccaggctggtctcgaactcctgacctcaagtgatccgcctgcctgggcctcccaaagtggtgggattacaggcgtaagccaccatgcccagcacgattaatggatttctatggaatttaatttcctttctgcctactgctttcaggtaaaaacgatgaatgattcagattcccctgatgatctcacttgcataactgagatcaggggtttttctgaaattcaccaggacttctccccttttcaatcactttgtgtgattggtattagcattagttctctagaactgctgtggcaaagtactgcaaacttggtggcttgaacaatataatttttttctctcatagttctggaggctgaaagtgtaagatcaaggtgtcggtggttccctctggagtctctgaaggacaatctatttcatgcctttcttccagcttctggtagcctcaggcattccttggctcatagatggtgttctatttatgccataataaaaatattagtacttactttttttttttctttttttttttttttttttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccacctcggcctcccaaaatgctgggactacaggcgtgagccaccgtgcctggccagtattattttttttaagattgtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgttttggtgggggatacagcccatgatgccttgtcagatgacacctctgatcccaggaggatccatgccgtggagacaaacaactcattatttgccttgatgacctgtcatctcatagacacctccctggatggatggagcactggaatttgggctaccagagagttccgcctcggttagcagaagtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtataactgcattccattgcactgcattaactaaaccaattctaagttcttttgtggaaacatggtgatcacttctccgcttgcatgcactaacagcccgcatttgaagcctctccccgccgtgtgcagccctgccaccctccaccgcacccgacatgcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcagcggagtgatcagagttcactgcagcctctacctcctggactcaggtgatcctcccacctcagcctcctgagtatctgagacaggcgcatgccaccacacccagctaatttttgtattacagtgacagggtcttgctatgttgcccaggctactctccaactcctggattcaagcaatcctcttgtctcagcctcccaaattgttgagattacaggcatgaatcattgtgcctggctctactcccatttctaagccctctcccacacccagcagtccttccagacaaacccagctgtctgcagctcctcccagtctacatcataatcccctggaatgcttttctgccttagtctgttcaggctgctgtaacaaaacacataaactgcgcgtaaaaacaacagactttatttctctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttcttaaccccagcactgcgaacatttggggctggataactctgcattggagggggctgtcctgcacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaaaaattacccgggcatggcagcaggcgcctgtagtctcagctactagggtggctgaggcaggacaatcacgtgaacccaggaggcggagcttgcagtgagccgagatcgcgccactgcactccagcctgggcgacagaatgagactccttctcaaaaaaaaaacaaaaaacaaaacaaaacaaaaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgcccggcagggagcagacatcccctcccaccccccaatgtccccactgatgtctgttgatcaactagatgatagacagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctatccccagggtctcaggtaaatgtggctttgtttaaaagcgcattctctggatcttctgttttcatttttaaactgtaaaagatagagttgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtccgcacccgggagcgggggcggctgctcgctctactcctgggaggggcctttcgaaggaccaggtgctgggcagaagccccctccctccctcagcaatgaggagcctgagcaaatgtgcaagggagggagagggagggggagggggagggggagggggaggggggggagaaagagagagagagagagagagaggagtcctggtccacaccgctcagaggaggggtgcggcagccacacactcaccaggtacacactcgcaatccagcacactcacagcgcacatgcaaacacacacaacccacaaacagcacaacccacaaaaacacacaatacacctccacactgcacaaatacacaacacacacatccacacaccacacacaaatatactacacacatccacacaccaccataaatacactacacacatccacacaccacacacacaaatacactacacacatccacaccgcacacactacacacattcacaccacacatacacactcgcaacttcactcagtgcacatgcatacgcccacaaatacaccgaacacacacatccacatcatgcaaatacactacacacacattcacaccacacacacatccacaccacacacacagatacataaacacatccacgtcatgcacatccaaatacacaacacacatccacaccacacaaacatgcactcacaaccctggactcacaatgtacaaacacacaacacatacatccacaccacaaatacacccacaaacacaccaccacacacactcacaaatacatgaacacagtcacaaatataaatccacgccacacacaaatacatgaacacacattcacaccacacatccacaccacaaacacacatccacaccacataatgctgcacactcacagcagacatacaaacccacatattcacacacacacacacacaaaacacacatccacaccacattcacaactacgcacacataaatacacatagcatacacacacaaatacacacacactcacatgtgcacacacaaacctacacattcacaccacacatacacacaccataggcacactgcacacactcccatggagacacacccacgcaaccctcacgcagctgcgctccgacactgcatctgcctctgttcctgaataagccgctctggaggctggaggcagctgtgggggaggctggcaggtcagagctgtgccgatgagccgtcgtatctatgctctgcgaaagcggccccagccaggaacactcccctctgccgcaggctggaagaggtggctttctctgtgcttatcctaagcccttccttctctgcctccacctgacatcaaagccccctggcaaagtaacccaggttaaggcaccccctcacctccaatacacaggtggtggtctgagtgggtagagtgccagatgttaatcagcagcaattaatgtctttttactttaatgaatcttatcacctttatcataaaaaagtgaagggaatgtgtaagacttcacttcttccatgagaccttcccattttcgtaagctcatttttaccagctaattcttccaacaacccagcctacaaaaggtataacgcagagtaggaattccagggggaaagatgtgcaaagtaaatcttaataaattttgaatcatattttcaatgtattgggtggggtgtgggcttgataattaaggagaatcttctgtaaaggttcaataaaatgacaaattcttttgtaaagagattactcattctgctgtacctactccctgaagctaaattgttatataaaagccttactttgaacaagctagggaagttccttaaggcaaggtggtgtcccctcagttctttaaaacacaagtatctcttaggtaagggctctgagtggggcctcttcctagctacatggtctcacggggtcatttaatgtctccgggcttgtttcttcatctgtaaaatgggagtaatattgcctgtctcccagggatgcaataagagttaaagataatatatgttcagtgtctggtacagactaggtgctcaataattgctagctgataactttggtatgaccatgcttttgaccaacccagatacccatccttgagtgtataaatccaacctactccgctgagctcagttcaaagcccaccttctcagtgaagtctttccatgaatatgctaattggaagtaaaccacctccttctgcaatctgcagtcaccccctggtactttatttgttcctttccacattcagctttgtatatcgcaatatagtcccggtgcatcttacactccctttacaccataattagcaagactcatgtctgagtcctccttgtgcaatgattgcacacagtaggggctccataaatgttccttaggtgattaatagcaatagtgtggtagaccttgtaggtggctccaaaaaaagcactccaccccctgaccaccagataacaatggaatttctgttgtaccacacataaggtagttttaaaatatgtctgcaaatttttcaatactcccctccttcaaaaggtaaagcttaatcctccctgtgtgcttggcaactctcttctcatgaatggagtgggggacaaaagacagtgtgatttctgagatgacatcaacaaaggcaatgtggttgccttctctcttttggatcactcactctgaggaagttggctgccatgacatgagggacttcaagcagccccacggagaggttctcaaaatcaataaatgaggccccctgccagcagcctcggaaacaagccatccatgccagccagtcctccagcctcagtccagcctttagatcactgcacctctggccaatgtactgaccacagcctcacaagagaccctaggcaagaatcccccaactaagttgctcccgaatatgatccacataatcagtaagataataaatgcttgttgcttcaaacttctaagttttgggatgatttgttatgcaccaatagctaactaatacacaacacagccatcagtacatagttctgatgctgacccaatcccggacaatgatatattaagaggaatctgctggggttgggatggaggcggcatggggaaacatttactaactcacacctaagggggccataggaagataaaatctctcttctgccacatttgtgtctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacgtcagagtttctggtcatgtgaaataataagtttatacatcgtataatctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaagtaacttttcctaggtcacatagctagtgagaggcaccgctaggattcagtacaggcctttgaactcaaagttgacattcgttccaacccaccaggctgatgatcaaagtggcacgctaagaaagcaccccaggatttgctcagaaaggcagccgggatcacatcagcagcaagcccaaactttaaatgctcactcgctacctccttatctttttgtggagctaaacattatcctctgccatgatgccttccaaagcaggacaggtcttgatgtgattttccacttctcactatatatggtattgtttctcagtatcctacaaagatgccaccaactttcaattatctcagctagggaagcttctgcaaccattctagcccacagtcaaggctccctgctctgaacccccactgtactgataaccagaaccacacagcttagtgctgaagggttttcaaattgtttcaagcatcttaacctgcccccatcagccaagctacctccttcttaaggtcaaactcctgtgccaaatactccttttgttcagcccctgagcctagatattacagcatttgatgcttaatatacacttgcccactgcttgatcaatggaagggggctgcaatatacatatacatacacacacatatatatatacacacatatatatacacgtataaatatgtgtgtatatatacacacatatatatgtatatatatacacacacacatatatatatacacatacgtgtgtgtgtgtgtgtgtatatatatatatatagagagagagagagagagagagagacagagacagagacagagacagagacagagagtgcctcactctgtagcccaggcaggaatacggtggcgcaatctcggctcactgcaacctctgcctcccaggtcccggttcaagcaattctcccgcctccgtctcgccaccatgcccagctaatttttgtatttttagtaaatatggggtttcacaatgttggccaggctggtcttgaagtcctgacctcgtgatccacccacctcggcctcccaaagtgctgggattacgggtgtgagccaccacacctggcctgcaatattttttcacacccggcctacaatatcatttttaaaatcatgtgtacatggctttttgctgcacagaaaagtttgacttgcctgccctcctttatgctttttctttcctctgttgatgtctttgctgagtccttatgaagtctttcctaatgccactccctaactcccaaattaagtcattcttcatctaggctgtcattgtgttctatacatatctttaatatacatcctattgctttatgattatttgcttttgaaaagtttttagacaatcagatgtgttaaaaattccctaagcaccaatgtctggttcatactagatgctcaataaatgttatgaaagggatgcacacgtttatcattcaaaggatagcctacgtctgctgtgttcctacaacagttatgacagctctcatcccacgacattccaatcatgtgttcgaatctgattcctcttttagactgtaagttaccaagggcaagaaattgattttttcaccattcttatctctaacataaatcacagggtacaaggcgagcattcaaatatttgtagataaatgtgtgacaactgtgatctatttagtcaagggttaaatgtgttactattccctaatcaatgaccagggaattattgagcaattcaaagacactgcttttgaataaaacatttaccgtacattatcacctggcaaagaaaaaaaacctgtgcctgttcaaaatattcttttgaaaatgtttgatggggaggatctttagttgatgtcataggcttcttcaagttggtgacagttccttgccaattggccgaagtcttccttggtgccttccatcaccagggtgcagacatgattcaaggatttctggtaagatctggccaggaaaatgtatcccacgagctcaaaactgccaagcactattgttaataacacagatggcctccttcaggaaagtattattttctttccctaaatagaagcaaggtaaatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagttaatcctgactgatcttctgccagaggtgacaacctatcctcggggtttggcagtgagcctgatgaagataagaaatgccagactgggtcagaccaatggcccattctggccatggcactgtctgacagaggcatccagaaacgttttgcagaaaagagctgtatttgtctcctatgacatcagtcatcaaaaatgtgcaaagtcctcctgaagcagatcatcttggggtgccccacccaacttccatgccacccttttccaagctgatggagtcctcattttgttcaagtgcttacttgcctacaggaggctcaggattaaatctcttttgccctatgccagggtttctcaacctctgcactactgaccagatcgtgtttctttgctgggtgggctgtcctgtacattgtaagatattttacagcatccctggtccctacatgctgatattagtagcatctcccgacaaacacctacctgtgaacaccaaaaatatcgccagactattacccttcggggagggaaagacaaaattgtccccagttgaaaaccactgctctaagccaatatgatagccccattgccttagccagtgatggttttaggggtgagcacgtgatccagttctgaccaatgtggcatgagaggaagtcatattgaggccttttgagaaatgttctctcactcttaagaagctacaaaactgaaagtgtctctttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacggcataaatttgagttggggttttgttacttgcagccaaaagcatcccaatataaacaccttcccatcttttccataacaaacctactttgcttctctcgcttattagtagtcaaaacatcacctttcaatgcatcccaatgccgtataggatggtttaaagagccctggagtctgaggcaaacagctaagtttgagcagcagctacacacacacacacagctcttaatttccttcatttcttccatgttgataacaccataaattctgcacccttttgagattgtgtaatggtcaaatgagatagtgtgtatgaaaatgcataataaactccaagtgctttgtgggtatcattacattttcagtccctaccacccccttcagagggtggcacgtctacatattcaccacccaacactcagacttcagctaacgtttattaagcctaactatatgttaagtgctgtgtatatcagttgctctaccttagtgctgttgacagttggagctggttaattctgtgtggaaggaagctgttctgtgcactgtaggatgtgtagaagcacccctggactctaccctccagatgccagtagtactcaccttcactcatgacaaccaaagctgtctccacacattgccaaacagagaacatttgtccctgaaggataaaattacttcacattgaaaaccattggtgtacaccctggtgacatacagataaaaagatttgtttcctgccctcaagtaatttatatccttctataaatgatcatttattttataacataaaacaaccacaaccattatttggtagcagatagatctaggtcccactctccgctagcttgtggatgttactgtctcgatctcagtttcttcatccagaaaatcggggtgataaagtctacctctctagatcattttcagaattcagtaaaataaggactgcaaaacacctaacaaagtgcctggcaaacaattagtacccaataaatgttagctttgcatactattgtgttcttggtttaaagattattgtctgcttttaggaattaggacctcagttcctgttaatcttctttactttgttctatgaacttacagacttgagtcccatacctgatatagatgttggtgctccacctgaactgcctcagatcttcttaccatttctgcaaagccaccctgaatcccaatagccagcaccttcatctttgtaggagagaaacccctctgaatattggaccccacattgccagcatgcatggtgggtcagaagtgtctgagagttaatatatccttttctgccctggaatagcctttgaaagatgactaatgggcacaggagtataaatacctcagctcctccactccttggcaggaataattctcaggtgtgcattttacattgatctcagagcttacctgcagggttaactttcagttcaccaccttggtatctggcttactaacatatgtctcactggtgggctccctctccttttatcacctcctgtctcccctgcctgtgacccccctacatgtcccagataaactaggtacattcaatatttaatcacaatctgtttctgagggacccaactaaaacactatccctttactttaatgattaagagttcagactcaatagttatatttcctgattagaatcccttttcaaacatgtattaattttgtagccatgggcaagttatttcacctatgactcagttttctttatgtaaaatgcagataataatactcacttcacaaggttattataagggctaaatgagttaatatttgtctaatacttaaaatcgtgattggcacttagtaagccctatgtaagcaattattccttttaattccttcgtaatcaatcctagtctccttggcagccagagtcaagtttctaggacttgggagaactgcctactacctcaagccaacatatcaggaattatttaagaatctaattttcaaaaacagtcaacagcaaaaagaaaacttctatttgcccaaaggataattccagactttgttagtgaagacatatgtggggacatgttgcctgcaaactgcttggattcctccacttgaattaacattcaggaaatatgcctgaataagtctgcatttgctcaataatctctcctggcctgggaagaagactagagatattagtgtctccaaacactaacatagcccaggtctgtgccctccagaaatgagcattcctcgggctgttgaatggctaagcagtattccattctgaaagacagtaataccccacacttggcctcccttgggctggtgccacaggggctcaaaatgtctcaacccataaaagacttctctccccatttcctctctccatctcaaccttggagggtttctgttcctaatgctattctacatggcagctgggatcagtgcaagctccagggccaagttctacaagcctccttcctgctgacgtggaggaaggagccgagggagagatctctctggccccagcccctgcccattcatgcatcagaaacttgctgtctctattctaagctatttacctcccagtcgttgctattccaaaagagagccagaggggaggaaaatctataacagtattttaatttcctgatatgacacactccatactgaaattacccttccaaagatcagagttccgcttggcaaaagcccagtgaatttcaatgaatgataccacccagaaagaacagagttttgttttatggatggtgagatgacaatgaagagatggattgcctatttatttaaatttatttttaatttacatttaaatgctctgtgtttactctatctcaggcactgtgctaagcattttagactcattatctcaaatgctaccttctcaagttgtcacagcattaccaccttatttattgattttttactatttttttttttcgagacagagtcttgctctgttgaccaggttggagtgcagtggtgcgatctcggctcactgtaacctccgcctcccaggttcaagcgattctcctgcctcagcctcctgagtagctggggttacaagcacccacaactacgcccacctaattttttgtatttttagtagagacagggtttcaccatgttgcccaggctggtctcgaactcctgacatcaggtgatccacccgccttggcctcccaaagtgctgggattacaggcatgagtcaccgcgaccagcccacaacttgcctgggactccgcagtcctcttccctcctgatttttttccattatacttagcaccctccaatacattatataatgaattgtttgtctgtctctcctgattaagatggaagctctataatggcagaacattttgtgcaatttttttgtgagcagtgcccagctcataggaagctttcaattaatatttgctgactgaaaggatgaataaatgaatctcctggaatctttctgataacccagtggaaaagccactgttatcatcactcccatatttatactcatacccataccatcctacctgataggaagaataaaggtctcccaatagatgtctatgtcccgataccaagaacctgtgaatatgttaacttacatggccgagaagacttcacagaagtgattgaggatcttgatatggggagattatcctgaagtccctggtttggcccaatgtaatcagaagtattcttctaagagggaggtagaaagggcagagggagacaaggacttgaagatgctacacttctagccttgaagatgaaggaagaagccaggagccaaggaacaaatacaggtgacctctggagtagggatccccaaaccccaagccacggaccagtaccagtccatgacctattaggaactgggccacacagcaggaggtgagcggcaggtgagcaagtgaagctttatctgtatttatagctgctccccattgcttgcattaccacctgagctccacctcctgtcagataagtggcagcattagaatctcataggagcaccaaccctattgtgaactgcacatacgagggatctagatggcatgctccttatgagaatctaatgcctgttgatctatcactacctcccatcaaccccagatgggaccatctagttgcaggaaaacaagttcagggctcccactgattctacattatgatgagttgtatcattatttcattatatattataatgtaataatagaaataaagtacacaataaatggaatgcacttgaatcattccaaaaccatcagcccaaccccggtctgtggaaaaactgtcttccacgaaactggtccctggtgccaaaaagattgaggaccactgctgtagagacagtgaatcataatctgagagtttacagaggagcacagccctgctttcacaaaccttgattttaacccagtgaaacccattttggacttcagtcctccaaaacatataatttatataataaatatgtgccactttaagctaagaagttcatggtaatttgttatggcagcaataggaaagtaagagacccattattcagatgatgaagctaagactcgagagcatgtcccaggccccccatgtagttaggtggtaggatgatgtagatgtaagtgcagtcagcttaactccacactcttcctcttgtcctctgtacaaagtcaagggagttgatcaaacaataagaaacactgtgtgcaacactcagttcctgggattttggtgctataaggtcatgactattccaccctgcaatctcttcagcacccactctgtactttgggactgtttttcctctccatggaattctaagctcaaataactgcagtcagttgtaaaagtgcacagacaggaacaagacacctcctgcatgggtctcagagtctgatggaaagggcagtcgtaagtgagtagtaataaaacattgggaagaaaaactccatgggtgcagggcattgccttttcacaggagtatccccagagccaagatcaatggctgactcatagtaggcacttaataaatatttgttgagtgaatgaatgagtagtaactcaaagtagtttttaaagtgctccaagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagcatgccagggtgagtgcaatactgtgcaggtggtacagaagatggggcagagagactggccagaccctgccttctctgccaggctggcctgctcctgtcagccacaggagccagctcagacatttaagcagaagggtaatgggattaggtaggtattttgtaaagactacacttgcactgttacgtgggcaccataacaatgcattttcatttgtcagatcactgtcacatactaaaaagtcttgtttgtgctgagagatctcaaactacctcttttactgaagacttcaagggggaaactacagaattataatggcctggaaggaaatgtctctgaaagacaaggatagtggccagtagacaatggcacacatgcccaaaacattgtcatcaggaaattcaagaggtcattaaattctactgtaggaggaaattaacacaaagatgatcccaatgacagatgtattctcatgataattcaagctcttctccatctggaataagagaaaaacaaatgactttccaaagagctgatcacatttaatcttcctttaaagacctgtgggttggatgtgctatcatcacttcacagttaaggagactgagccccgtgggccagttttgcagagctggtgtttgaacttgggcagctacaaagcctgtgctccttcccatgctcaccctaagtccttttacatatcatgcactgaacttccaacaggaacggtcaagtccccaagacctaggccctgtccttaaggaatcgccatctgccccaggggacatgaatgatgcttctagccagggagaggggtgggctaagatattccgccttcaggttgctgggagggtaagtgtgaccagggctggctggcggtaaagacctcccggaaaatgtaggtcctgtgctggatataaagaaaagatctgttgaggcaggaagcttcaatcactagagcaaattccacccaaactgggagcttctcctaaatggagatcctgagccctatccttagaatacagagagtgaggccaggcatggtggcttacacctgtaatcccagcactttggaaggccaaggtgggcagatcacctgagatcaagagttcgagtccagcctggccaacatggtgaaacctcatctctactaaaaatacaacaattacccaggcacagtggcacactcctgtagtcccaggtactctggaggctgaggcaggagaatggcttgatcctgggagacagaggttgcagtgagcagagatcacgccattgcactccagcctgggcaacagagcaagactccatctcaaaaaaaaaaaaaaaatacagacagtgagtctgagtaaaacttgggaatctgaactttgaacaagccccactagtaattctgccactgttcagggccacaacagtgaatggagaagagtaggatggagacagaaagcttttaactgaaactttccaaattcagcaagaaaatcaaatgactgagacagaagatttctgtagttgactagcagaggatcctatggaaaaggtggtttgatctacaggaccttaaatgtcaggctaaaaggaagataatatattttgttgaacatctaccacagatcagaatctaatcttgtctattcttcacaacaaccctctatgaatattcccactttaaattacccaaagtcagccagctagcaagagaagagctggagcttaaacctgaaatgtgtgcctctctgaagcccataattattccactacacaccgtctctcttaaggactgtgagtgacgaatgaagcagagtcactggtatcttttgagcaggtggtgacaagttcataggagttttaggagggcaaatgttgcactaaggtggattgccctggggagaaaatggagccaggattagaccactttgcctagtctacatcctgccacctgctgttacaacgtccttctgttgtcagggtcactcatgaaatgcagtaaaagagctgtattagttggtgcaaaagtaatcgtggtttgtaatggcaagaaccgcaaatacttttgcaccaatctaatacatccataaatggatatatttgaatatggaatgacaataagaagttaaaatttaattttaaaaaactgaacagaataaagaaacaaagccaaagaaaggaaaagatcctacgtggataaagcagaaacctccacacaagagctgtattattagttggtgcaaaagtaatcgtggtttgtaatggcaaggaccacaaatacttttgcaccaatctaatacatccataaatggatatatttgaatatggagtgacaataagaagttaaaatttaattttaaaaaaccgaacagaataaagaaacaaagctaaaaaaaggaaaatatcctacgtggataaagcagaaaccaaaagtaaaccaagcgaaaaaaaagaagccaaataaaactataagctgatcttcagaggaaaaacattaaatgaatcttctgacatgactgttcaagaaaaacaaaccaaagaaaagaaaacccaaatggccaataaatgtgaaaatatgttcaacttcttaataagataaatgcaaattgaagaccatggttagattccgttttacatctatcatataagcaaaaatgaacaggactaatacaaagatttaaagagatataagaaggttgcaacttttcattccttgctgtgggaacataaacaggctcaatccttttgcagaacaaattggcaatctctggtgatgttgaagatgcccacatcctatgacccagaaattttacttacaggcatatatcattaagaaaatttctcatctgtgcaaagatgttctgtgtttcgttgatttaatgacaaagtgcccatcattcagttcatggataagtaaaatttttatacatccatagggtggatatttaaaatataaatagttaaaataaatccactaaagctacatttataaacacagataaatctcaataacataatactgagtaaaaaagagtaatttgggccaggcgcagtggcttacgcctgtaagcctaccattttgggaggccgaggtgggcggatcatgaggtcaggagatcaagaccatcctggctaatatggtaaaaccccatctctactaagaacacaaaaaattagccggacatggtggcacgcgtctgtagtcccaactactcaggaagctggaggcaggagaatcgcttgaacccaggaggcggaggttgcagtgagctgagatcacgccattgcactccagcccaggcaacagagcgagactctatctcaaaaaaaaaaaaaaaaaaaaaaaaaaaaaaaaaaaaaagaaaaaagaaagaaagaaagaaaaaagaaaaaaaaaacagtagttggaaaaatatagtactgtttataaaaagcataaaacatactaataccattataccctaggtttgcatgtacatatagaaaaacacatttatcagctttaggttagtggtttcctctgaggaaggagataagggaatgaaatgagggtggcaggcttcagcagcatctttatatttttaaaatctgaaataaatgtgacaaaaatattaacatttgttaaatctgaattgtcagtacatggttgtttgttattttattctctgtacttatcagcatgtctgaaatattccaccattgataaatcctggttttgaaagagaaaaagaaaagatttaaacacaataataggatgacttctctgagactccttagttcactgcagatatccagatcaatgtaaaaaggatactctgagcagacaaaacatctgggaagacctttgtcacatctgatgaagtgaatccatctggcaccaagctgcaaactccctattaacagtgcactggcaaactcagtcacttcaatagacaacatcagaataggtgcttttaaattcaactaagcccttccttaggcaaataagataaaagcttcaacagaaaccaatgtagcccaaatttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctaaacagcaggaattatacccaacatttaagttctttctcagggtttcactaagcatactccaggctagagacagctccaggctggatattgcaccaaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccacccttgatccattcaaccctacatctttccactcatccattcaaataatcattcacccttctctttatacaacaactcctttaccaatccatcctcttccccttccagccaggctggtcctcccttcccattctacacctacccattaagccaccttccattgcttcatacatccatctcttcaaccctctaaccacctgtattgggttgagcagcatccttcaaaaattcatgctcactcagaacctaataatatgaccatatttgaaaagaaggcctttgtagatgttatcaactaaattaatatgaggtcatactgaatttggaccccagtccaatgactggtgtcctgaagaggagaaaacacaggaacacacacaaggagaaggccacataaatatggaaacagagactagaatgatgtacctacaagccaaagaacgccaagggttgatggcaaccaccagaagttagaagatgcaggggagggtcttcccttagcatccttggaaagagaacagtaatgccagaaccttgattttgaacatctagcctctagaactgtgatataataaattcctgtggttttgagccacgaagtttgcaggactttgttgagcagccctaggaaactaatacaccacctcccctaccaactactccatctctccaacccccagccagtaatcttctcaactatacaaccctccacccctccagccttctacccatccatccctccacccatccatccagccatccacccaattccccattcattccatccaaccatgcatccatctatccacccatccatccatcattcatccattcacacatactttatttagggtctatgtgccaagtgttgttctgtgtgctaagtgtacaatggcgacaacagtagtagcacgatattatgggttcttcctctgacatatgctaataaccccactaatatcaccagacctcaagaataaatacaatctaagtaaatacaatgggcttgctatgcaaactgaacttcaaggtaagttccctaggtattcctgccacttgtaactatgttggtggcacttaggcccttccaatataaatgttctggggcctccactagatgaggagcaaaatatccaaggcctcttcccaaatggatatatagacaataaataaatcatacaagtaaatatatatttatcaattttgttgaattctatgaaggaaaaaaatacagctctacaaagaaaataacaagggtgcaggggacagggcactaattatgattagggagtaacagaaagcctctgtaaggtggaaaaacaaaacaaactcataagtagttaaaaaaaaaaaatcacttcccaaagaggcttacacgatcagggaagtattgggctttgggtaagtgctacacactctcagaggacagggagtccactgaagactgcaaagctttcttgaagaaaagtctgcctggatactgaaggataaatgacagttaagtaatgggagggatacctatttttagcgtggtcctcaataaacaaaagcgcagacatcactcgttcattttaagagatcttgacttttatgtgccaacgaccactttggcaggctggtgaagccttcaaattccttctcagaacagagctgtcaaataagtaaaataaaatacgtggccgggtgtggtggctcatgcctgtaatcccaacactctgggaagccaaggagggtggatcactcgaggtcaggagtttgagacaagcctgaccaacgtgttgaaaccctgtctctactaaaaatacaaaaatcagctgggcgtggtggtgcagacctgtaattctagttacttgggaggctgaggcgggagaattgcttgaacccgggaggcagaggttgcagtgagccatgatcaagccttgcactccagcctggtgaaaagagctagacactgtctcaaaaaaaaccaaaaaacaaaaaaaccaaaaaacaaaaaaacaaaaaacaaaaaacaaagaaacaaaaaaaccgctagattacaaagaaaacaaattatatcaaaatacagtcataatgatgttttaaaacaaacttgtgttatgtttatgtcggtattaacatgctaaatcacaagatctgtgctgtgtctactaactacaatgatttcaaaataatttggcaaaagtaaataattctgaaatatctacaacaatgataatgtgataagaaatatgtaatttctcttggtgaaaaaaaatcagacagctgctattactgtgatttcttgctacaattcaaaatgaaaagaatgaaaacttttgttagaggtaagtaaaaataagcaatttttccccatccaagtttacagaccactgagttccatccacagaccccttaggggcccgtttatgtgatttatatgtttaggtatttatgtatttgtccattcatttactcgctcattcatcccccaaattctgaatgtttctgacattcctgacaatatggttagtgctagcaatatacaaggccaaaaagacagatgtggtgtcttccctaatgagcttatattctagtgggcagagacagtcaataagcagataaacaagatagttataggctgtgataacaatagattgtgaaaaagaatcaacagagtgatatggggaaaggggaggttcacctggtgttggtacccatgatgaacacattatgcagcaggatggggaatcataatacatggaagagggattcagacaaaggccctgtaacaggagaagaacttgggcatcagaagaacaggaggacagtccatgttgctggagtgaacatagcaataggagacagaggaaatggcgacaaagatggagcagctgcagatgtgctgggccccacagactatgggaataggttttagttgtgccttaagtgcagtgggtagccatggaagcagtgtatgcaggggaataacagatctacattatattgttttaaaagatttctttggacactgaatagagaatggattgtaaagaaaaagataattgatagaagagaccagtttagaggccattgcattcatccaagtaagagagtggtgacttgatccagggctggggctactgaggcatctacgggtacagaattcaaggaagaactcattctcagggccatgcaagtgcaggattcagctacccctggctttgactggtggtagaaatgggtaggttgatgatatattttggaggtaaaatcaaatttgttctaaaaatttctgaagttcagaagcaaataataactttagaaaggagcccatgcctcagacaacagagcgtcttaaacaacagaggaaggacttttgactttctcctgtagctaatgaagggccatggaactaaagaaataaaatcacaccatcgtgaccgaaaaaaaaaaaaaaaaacaaacaagatttttagagggtggtgagaggtaagaggtaagtgaagagaatgtttgggcattatgtgtttatacaattttagattcgtgaatgagttaagacccagtcagggaaacggaaaccactccaggtgtttccaacagagataatacaggaaattggttacataggagccactgggacacagagagaaaaggaaaagaggaagccattaatatcctagggatggaggaaaagggggatgcaggagacattaccaaagttcagaagctgggtcgcttggcagtagcaaatcccacagcagggaccacctgataggaattgggaccctggaggctgcccatcaagagctagatggggacattcccaaggaagaggaagtgagggagaaatcacctatagcctggataaaatatgtccttgcatatagaacagagaagggaaaggtcagagaaaggattgagaacaatcaggctaccggagcagacccgggaacaaagtcctcacagcccaatcctctatactagaaagagaaggaaaatcaataggtactaggcacgaaccacatgccggggtctgtgcttcacgttttctgatgttgcctcagttctgtcccacacattatctgtttagcccctactgtgacctatcttatagataagaaaattaaggctcagcaagattcagaaacctacttagggttcctccgctagccagtggctaagctggcacctaaacctatgtctggaggaacccaaaatttatagtctttcctctgatatccattgttcttcaaagaggattatctgctgttcattaaatgctaactgcatgctaaaaactgttcctagtgcttgatcttcaatgtatcatttgttcctgcaagaaagtcatgattacttttagcaccatcttcattatcatcatctttgctactattattattttcaacttacagatgaggaaattgagactcagaaaagttaaatatcttgccccaagtcacaaagctagtaaatggcagattcaaagccagggatatctaatgaaagctgcgtttcctctttacgagtgcaagctatatggccttccattcataacacacccacaacagtgcaagccaaaaaccatccccaaatctaacttcctaccatattgatcaaagtattcattctgaaagacatcagagcagaaactgctggtttcccacccaatgtcggttctccttttcctttttagaactccagtttaattcagaaacaatgtttctaggtaaaatattctattccccagccttcctccctatcagagatgaccaacaatagactgaaatgctggggtaggatttctgagctcttgaagaaggggcatacagctagagtgtgccctttttgctcttctcctccttattcttgtttcctgctttgagtgtgaatgtgatgcctggagctccagcagccatcttggatcatgaagcaactttaatgatgcaaaccatgtgcttaagagtacaacagaaatacaggaagaggcttaatctatgaggacaccatgaagccaccttggcaaccctcaaccacctacctccaggctgctttaatctgagaaggaaataaacttctcttttgttttagcatttccaggcttatttattggcaaacacaattcctaaccaatatatgcacctgcccgaatactaaaatccaatgaatagagattcctgagattcctttacatactcatttccactcattcactctgatttaaatacagtcaactgtgtgtctcactttgattgatggggtgccatcaaaagcaaaattttctcccttgttgcttctgaaaaagactcccaaacccacagtgaagtcagtctggggcagagagaggtggtgtgatattatatatgtcattataaactctaagtgcctcttttccgaactcttagaaggttagtagtggcaaaggcaacaaaaaagtcacagtgatgaatagaacatgttggaaagtggctcagagagtaggaattaaagaatgccagctccagtaaatgtcacatatcaatcaaaagtgaagaaagggagttccctccaaaagtggcagaggggacaccttcataaacagaacataaaggccaatcgaactcagcagcaaaatgggacgtattcagccagagcctgtcactttgtacaatggcaacaaaccattccgtcagcttctctgctgaaatcagagaagtactaaaagggatttttgaaaccatttgctcagtgcctccattacataggggaggcaactgaggatcagatagggtaatggccggaccaaagtcacataaaaaatgaatggctgaactgggatgagatggaaacccaggtccggtacttgctgacttctccactgatgtacataccttctttatggattgcgagtatccacttctacctaaggcaggagttgataagctttctctgtaaaaggtcaaataggaaacacttcagattacaactactcacccctgctgttgtagtaaaaagcagccctagacagtagaaaacaaaaaaagtatggctgcattccaataaaaatttatgtacaaaaatagctagctggatttgacctgtaggctgtagatggccatgccctgacctatgtcactgggttcaactggtcaccagaccaacagcatccagacctttctagaaatgcaaattgtcagtctctttgcctccagacctaatgaaacaaactccagaaataacattcggaaatctgttttcacaagctttccaggtgactgacacacactaaagtttgaaaaacattgggttaacacgccgggcacagtggctcacacctgtaatcccctgtaaacccaacattttgggaggccgaggtgggtgtatcacctgaggtcaggagtttgagatcaacctggccaacatggcaaaactccatctctactaaaaacacaaaaattagttgcgtgtgatggcatatgtctataatcccggctactcgggaggcagtggtagaagaattgcttgaacctgggaggcagaggttgctgtgagcagagattgtgccactgcactccagcctgggtgacagagcaagactctgtttcaaaaaaaaaaaaagaagaagaaaagaaaaacattgggttagcaaaaagacacatgcactcatatgttcgctgcagcactattcacaataacgaagacatggaatcaacctaggtgcccatcagtggtggattggataaagaaaatttggcacatatataccatggaatatacacagccataaaaaagaacaaaatcatgttatttgccgcaacatggatggagctggaggacattatcctaagcaaattaacacaggaacagaaaaacaaatacttcatgttctcacttataagtgagagctaaacactgggtatacatggatataaaaatgggaatagacactggggatgatgataagtgtgaggagagcaaggctgaaaaactacctgttgtgaactatgctcactacttggatgatgggaccattcatatcctcagcatcacagaatatacccatgaaacaacccagcacatgtatccactggatctaaaataaaagttgaaattataatttaaaaatgggttagaatcatagcaaatcactgtgcatgagccccgcctagccatttctagtacataacctggtatttggcttctagtagatgcttatgacagcaaccataagcctcccacccaaaaatctattctctccttctttaacatgagaaggaaataaaattcttacttaagccattgataatctggattttctgtcataaaccaccaaactgaatccaattgatttagtatcccgtgaatatttgttgaatgaataaataattctcaagcaaatcagaggatctaaattacatgttacaggtaggtttgattagtacagaaccactgcttcaatatacttttatcagtagataaaatcctcctaaaaacagtgtccataggagtcaaaataataaaaaagaacactaggtggtgaaaatattggaaacttctagacgtacagtagccttcatttcttgcaccgccaaaagccgggctgataatggagcaaataccctcttcccaggctcccctgaggaagctgccactttattcatgaccccacagtcaccgtctcctggaagcctttcctaattagagcccttctagaattctgggattttatgtctcagcagtatggtgagaacaataggattgttctgttctgctttattcgaatcatactgatgtgtcatttttcaatgatccttaagttactctcaaacagagagcttttcttacccatggtaggttctcaatcgatgtctatagaattgaactgactttgttggtgagtgttttgtttcttccacgagaacagatattccttcagaatcaggggctgactcttctatttttcaaacaacccccaaaactagccacagcaacatgcaggggccctgcatcaacaggtacttgaatgctggtaaatgcgtcccaggcacctcacttcgttcgcccattttggtgcatcagaacaacgttgtcactggtctaacctcatcttcactccctggggactgaggtcttgcctgattcccaaagccctgcaccagagatcctcaaacattttcaactaggactttatcaacgggaaaaagatggacagcttcactccatgttaacccagcgactccatcaaacctatgcttgtttctactgttcatgcctctacattgatgtttctcaagcttttatgatccaggtctccttgataaacatttttaacctcacattttcctctaatgctatttgaaatggcaagagaaattaatatggtgactaaaacatatcaagagatgtcatagttcaatagaccctgctactaacaaccccaggtgcaaatctttgcttcacatgctattctctgactcttacttgcatagtctgttttgacttctccatgtgcttcagtgaaatgcaaattactgtttgatcccatggactagactatggggaaatctccattgtttcagggcaagattgatattcagctggttgtttatggctggcaagcattcacacggtcagtgcattcatccaaacggacgaatccccatgcctcatcaattgttacactttttcaatgtcacctacctaagaaaatcagaatacaccgtaacgtggagaatccatatgcagataaatgaaagaggagagtcaggaccatgcaaaaaattacagggaaatttagcaaagtctggtgataacatagactctccacacagcattcaacacaaacagaaaattaatctctgatgcaattgggcattcatacatgccagtaagttctgtactttattttaaggtacctcgcctgcctggcatcagttgggagaattattaaccatcattaaatgattaactgtcactaaaatggtagcctgctgccacccagccaagagcatgctgtgtggagttactcacgtgagaaaaaacttgttagcaaaagaatgcacctgcaacccagagcatctactcttgtgacattctatttcggcctccttgttacaaccacgattttctttctctatctagcacaatacatatgccacaggagtctctcaacttcaggttaattacacccatctctctaaggtcagatcttcagaattcatcctttcataaagttgttttaatgcatgtttaaatctctgtcatttgctcactgtgtgacttcaggcaagttattgaacctcaattttcttatctctaaaatagggctaatcatagctcctacctcataaggtttttaaaagaattcagtgacagcatggatgaagggcatctagcatagttcttgacttgtagcgtgtgctcagtagtgttaataattatggaagagctcattggccaccaagtgaatgctaagctggaagaggattggatacattatttactccaaccccatctcaagccaagactataaccctctcaatttcatgggaggttgaccctctgtcatgacattggacaaacattgggagggggggcgcttaacatggtttggtcattcctcccacggtctcagggtgatagatactgggtggaaacatgggtctcttacgaatagagagctgaaagtcacctacccataccttaaagagtgttccttgagagagggctttcggaaatggatttagacatcatgaatccaacaactaagagatcatttatctgtcctcctgacacttccatagtccatctcacccccagcacatcttaggaactgactagaaatattcttcagactttagaaagcagacgatgctcttcatcacggcagaatttcatatcccccggtgttggagtgggaggctgccagcctttgaagtttgggatgcgtcttcctctctgtgcctctcaggggcctttacttctgctacactgcacatctggggagggttgcctgaacactagctcacgaagtggccgctgggctccttcctggagtctaatcctgtctgtctcatcgtgtccttctggaaacatcaccaacttatttatctctgtcataaaaggagaggaggaaggagcagcagagagtttcaaggttaaccaatgtttgcagagtaaaaatggtacctgaagacagatgtatgctgcaaaatagcagttccatacaaatgcaagagggcgtcaaagtcaacagggacaaaactatgggctatttcatgttcctcactgagtaagacctcactcacaatcacttattctgattataaaaatgatgacctacaaagagacccatgtttccacccaggatctatcactctgagaccttaggatgagtgactgaagcatcttaagctgcccctcccagtgtttgctaaatgtcatggcagagggttaacctcccaggagattgagaaggttaaatgagataccacgtgtgcagaggccagcatggtgcccagctcagcagtaggcacttgggaaatgtcacctttaacactgatatgtaagaccagcccatcatagcagcattattcacaatagccaaaggtgggaacaacccaaatgtccattgacagaagaacaggtaaacaaaatgtaaatacatacaattaaatattagccagcgttcaaaaacaaaggacattcggatacatgctacaccagcacactccctagctcacgatattttaagtggatgaataaatgaatgagcaaaaaaagagcaccctacctctaactggatcccccagctgtgaactctctcacattttttctctagcaaattccctcttttttgctgtttctttctcctcttttctgttctattctctttcttcatcccctatgctttaaaagacacttgcatctggggctttttctgaagccgttttttccctcatttttttctgtccacaaaacagcaggaaataatttgctttaaatccacataaaatacccacgaaaaattcacactccatctctgaatgaggaggctaggtttttccaacggtggagccacaaaagtctgttttgacaagttatctccccgtaaacatactggtttatctcatgctgaacaattagatgtgctatttaggcaaaataaaaaatatattgcacattttctagacagcctgttagcatccatgccaatgacacgaacatcaggacatggggctgatattaaagtaaccagaaacacaaatgtgtattgcaacactcggaacattgccatctgtgtgttgcatgcccggagggacacccagggaggactgcgtgaagacagggtgagaaagagtccaggagaaaaacagcagctgagaggagtggggtgggcagggattggagtagaagcagatgggaggctgagattacccacaggctaagccagtggttctatactggggacacattcccacccccaccccaagggacattggcaatgtctggatgcatgagggttgtcataaattgggcagggggtgctactagcatggcatgggtagaggctacatgtcctgcaatgcgtattatatccaccccctccaccccacagcaaagaatgatgtggtcccaaatgtcatgatgccaaagctaaaacaactccaggctaagatgaagcagagtacagatcagctctgctactcagtggctgtggaacttgggcaggttaattaaactctctaggctacaagatggctgaaagccatctgtgggatagatgagatgagatggcagatgtgcaatgcacatagcagctgtttccatgaatgctaatcccttttatgctctccttgtggtcctctgctttcccaaagcgtatttatttactaattcactcagttctttaaccaacatgtattgagtgtctactctgagcctggagctgggtgctggatattcaacaacagataagaaaggcagagaccctgtactagtctgttcttgcattgctataaagaaatacctcagactgggtaatttataaagaaaagacgtttaattggctcacagttctgcaggctttacaggaaacatggtactggcatctgcctggcttctggggaggcctcaggaagcttacagtcatggtggaaggtgaagggggagcaggcacatcacatggccagagcaggagagagtaagtcttggggggaagtgctatacacttttaaatgaccagatctcaaagtaactcggagcaagagttcactcagtaccaagagtgtggcccaagccattcacaagggatccacctccatgatccaaacacttcccaccaggccccacctccaacactggagattacaattcaacgtaagatttgggcaagacatccaaaccttatcaattcccccatggatcatctaatgtattgggagaggcagataatagataatgtacaaaccaaactaaggttagtgccatgagagtaaaggacagaggccagagactaacacccaatctagggtgatcagggaatctgtctctggggaagcgacattgaagcagagacctgaaggatggcagagttttggggattggtgctggttccagacagagagaaccaaatacacaaagactctaagaaggaaagaaaacagggtatgttcaaaactgacagagagcacaggtgacaactgacagagcacaggtgcgtggtggggagcaggtggcaagaggagagggataagacaggtgggtaaggaccccgcagttcatgagaaggcacctaggttctagccaccaagatgtcatgagaagcccttaaaggctattcagaagagaagtgacctgatccaatttaccctggctgcaaaggaaaggatgaagtaggggaggagtagaggtagaagcagggagaccagtggaggctgcttcatctacagctccagatggtgatgatggtggtagcactggagatgaggaaggatctgagatatacatttgaaggagaataattatacattgcactagactctggtggggatgagagaaagagaatgttccaccattcactgggtggtcaggctgggcagccaaggttaaaaggctaagtgtcatccagggaagagaccatcacacgatttgaggttgctgagaacagacaacacacacaccaggctcaagtggtagagcaagaggagacagactacacaagatgcagtcccttgcaatgcgtcagtcccccacagccagtggatctgctctgcagtcaacccaggcagtgcagctgcacacacccacctcgtgctgcagtagaaggacccagatccctttccaccagggacagatatagtagcaggtttggccaggggccattagatgcacacacttgagcagaacaaagtacatcaagcccagaacagggaaagatatttccaggcaaagagatatgcccagcccaggctgggagggctcttcatctcttgttaaggaaatgtttcaggcccaaggccactcatacagccatacagggtccagcaagctgtgcatgaccacctttcccaatgcagtgaaggatagatcccacgtcttgggcttaggcagttaggtggatggtgagtgcaattactaaagagagaaagacctgggaaggaacagttaagggtggggagcaagaggaagacaatcaagaaatgctcagtacctgtgggttccctcttgcctatccacccctccctcctacttctgtttctctaagctcaatgacaatgttccccactccagcagctctagaattcattcatacctgggacttcagtggcaacgtctgctcttctctacctgagtggtagccaggaagtctgagtcttcatcctcaactcggggaagtcctggagcccttccctggacatgggtccccgagatgccagcaatgttttctaggtgccccaggtgctcctgcaccacctcgaagcacctccatttaggcctcctgactttgtttaccaagcacgcctctagcctcgctactcacagtggggtccatgggccagcagcatcagcatctcccaggagcttcttagaagtgcagagtctcaggctccagcccagacttgctgaactggaatctgcattttaaccaaatcccaggtgatttgtgcatgcgtgttaaagtttgagaatcactggtccacagctcagaagccagccatctacaacattgccatatgtcagttatttgtaattacagttaaaaaaaaatgctaccagcgtggcctgggatgatttgttcttaaacttcaagggctgcttgaagcccgagatcctagtgacactgagatatttataaggtttcccttcgtattctctgagcactcctctcatcatcagattttccagatgataagtttttagcaggcccttcttccccctctactcctgtgtggacctctgggctgcctttttcaggttttgcaaactggctatgaattgttcagcggttggattagccagttctgcagactgcctcacacgcagaccatctggaccgcttatagagaagacatgttccaagtaccctctttcctttgtctgcttttctcatgggtactttgccctctaagaagcctactttcctcttttcctctcctcctctccctatttctctttgttgagagagcagtcagattaacccaacaactcttggagtgccttggtcacctgagagcatggaaagtccatgccctcaccagagtaatgactaccatttctccaaaactctcctcatgccatccgataggcagtattgatcagaaggggaaatctagtgtgttaaaattgataaaccagcttaagtaatacctacataaaagaaccatgcctagcacatggctgaatgttgaatactgttgcatggaaatttgggatttctagttagaggctttataaaggtagaatcatgcagacacatatacctggaaatattcggaacattctattagcagaaatgcaatgtaggaagcttattggttctagaagaatgtgtcattgtcagtaattggaattactgacagatccagttgaagtaaggggaaaaccacaaagagtctgtactcttaaaactgcaataatagagtcaaggagtcttacgggacgagccatgaatcttgttaagaatttgggcatgtatctcttctggttgtcctgattatgtaagtcccttcttcaccctaataacactgtattgagaaaaacttcaagtgcattatgcccccaggatgaagctataccttgttaacaaaagctgtgcctatagaaagggattggagtggagtttgggaaggcattgtatagaggacaaatgatgagtctcaccagacagggctcaggtggtaaatgaaagggatgtactgagcctgtactcttgagagcattttgggcacagtacctggctgctgcttctatcaccagtatggtcccaagcaccagccctgcctgccactatcacttcttgaaaggcaacccaagaggagaagtggacgggagccgacaccaggcaggggttaaattgtttatatgcatcatcttgtttaatttttaagacaaccctataggtacagtacttttgtttatctccatttcacagagaaggaaatggaggcacagaaaggtgggtaggttgcccacctaagtgatagagctaaaattcaaaccaggcagcctgattccaaagcccacactcttggccactacataaaagattcttcaccagaatgaccttggtaccataggttcatgatcagaaagtgatgatacctctatctggggacttggaaacatccatagctccttcaatgagcccaggacaatctttcaccatcgtgagagtgagcaaagatgtctcaagtgatgccctttgtggttaagcatcatgaggctgttgcattccctgctggtagggaaattggaggtacgtgcacattccatcccttgcaattctgtaccttccatttgcagcatgagaataaacaacaagttgaaatgtgtttataagagtgaagcatcaacttccaaatccagctgacctgtgtgggttaaaggacttagcaaagagaaacaagtacctacaattttatggctccgatgcctctcagctttggctgcaatttggaagtacccaaggagctttaaaaactactgaagctggggtcccatgccctgagtttctgttttgatttgtctgcactgtgccctaggatggagggaagttgtaaagttctcctaggtgattatagtatgcagtcaagtttgagaaccactggacttagcctctcttgggatctcagaataagtttgggtgggtaggcttctagaataaggcagtgcctctaaagacgtggtctgtggaccccctgacatcagaatcacctgggaatctgcttaaacatgtgcatcctaggctctatccctaaatttagattcagtatttctggggaatatcccaggaatccacatatttaacaagttatctgggtgattgtctgtgctcactgaagtttgggacactagagaatagagagtagtcaaagcctatggctggttttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccctccctcagcctcccaagtagctgggattacaggcacccaccgccacgtctggctagtttttgtattgttagtagagatggggtttcaccatgttggccaagctggtctcaaactcctgacctcaaatgattcacttgccttggcctaccaaaatgctgggattacaggtgtgagccaccgtgcccagtcaagatcccgtaattcttgagcattcctgaaacctagggaaagatggaaagtgcttgcaggcaaggcccatggaagacagaaaaatcatttatagactgcagtctctaaagacacaggagtgttttaccacatgctgatatcacgcagggttggtctggggaagggattctgaagccaggggaggtagttttggccactgaagtcctggctcaatggaatcacttcttccctctcagcctgacaaagcaaagtgggctagtcccatcttccttacctccaaaaccagtacagcattaagaaattcctaatctaccgtgatgtgtgagggtcaaaaaagtgggcctagaggtgaaaaatggatcatagacaaaatattagacatccttcaccctttgtcaaaattaaaaacttttattcatcaaagggcactattaagaagtgaaaatacgaccagcctggccaacatggtgaaaccgcatctctactaaaaatccagaaaaaaaaaaaaaattagccgggcaacagtagcacgtgcctgtaatcccagctactcaggaggctgaggcaggagaatcacttgagcctgggaggcggaggttgcagtgagtgagctgagatcgtgccactgcactccaatctgtgtgacagagtgagacccccgtcacaaaaaaaaaaaaaacgaagtgaaaacacgacacacagaaaatatttgcaaattatatatctcataaaagtctagtatccagggtacatagagaacactcacaactcaacaatagaaaggcgactccgtttttaaaaaaggcaaagggtctcaatagacatttcttacaagatggcatacaaacagccactaagcacataaaaatatgctcaatacaaacagtgattagagaaatgcaaatcaaaatcacaatcagatagcacttcacactcaccaggatggctaaattcagaagaatggaaataacaaatgttgaccaggatgtggagaaataagaaaccccgtacactgattgtgagaatgtaaaatggtacagctgctatggaaaacagtacgacagttcttcaaaaagctacacatagaactcctatatgatccagcaattccatttctaggtatgtatatacccaagagaactgaaaacagatgttcaaacaataacttgtatgtaagtgttcatagcagcattactgatagcagccaaaaactggaaacaatctaaacatcctacaatcaatgaagggataaacaagatatgatatggccattcaatggaatgttatacacccataaaaaggaatgaagtactgataccttctacaacatggatgggcattgaagacattatgctaagtgaaggaaaccagacgcaaaaggccatgtattatacaattccatttacatgaaatttccagaataggcaaatccatagagacaaaaagtagatccatggtttctagggctggggacaaagggagacagagtgacggctaaaaatatgaggtttctttttgtggttttggaactgttctagaattagggagtggtgatggttgcacaatatagtcaatatactaaaaagcattggactgtgaactttaacatgataaattttatgtgaattatatctcaaaaacatttaaacgtaagactaggtatcacttattgaccaatttctccttgctggcctaagtgctattatacatagataaaatttctggctcaatccttcaaagaatcctccaatgaaggagtttccattattatcaaaggacagcccagtgtaggcattgagaatgtggttctgacgccaggccacatgggttaaaatctcagccctgaacttgctgggactttgcatgggtcctctcctatgcagtttcctcatctgcatgtcggggaatataatggtatccagtacctggcgcgtagtcagcacctagtaaattttggttgatcacttaaaggtcctcctccctccttccctttcatcctgagtttgagagtttcacagtcatactaaatcagattaggaaactgagccctagagaaatgacgtgacttgtctaaagtcccgtatcacaaaaagataaatttgtatgcctctacttatatgggatacctaaaataggcaaatttatagagacagaaagtagaatagtagttaccagggaccaagcagcggggcggaatggagagtgattgcaagtaagtacagagactcgatttggaacgatggaaaagttctggagatggatactgatgatgattgcacaacaatgtgaatgtacttaacgccactgaacttaaaaatggttagaatagtaaattttaggttatatatattctaccacaataaaaaggaaccagtccatcaaaatgagtgtcatccaggacagtcaccctacagggcaccttgatgacacatatcaaagtcttaaaaataagccctttgactaacacattctgtactaggaatttctcataagaaaataatcagacaagtgttagaaggacattcatctcgtcaatatctaaaataatgcctctagctgctctaaatatccaaaatagagaattaaatataattaatatgctaaaaaattaaaaattaaaaaataaaatcctacaactagtgtttataactctgggctctgaacccagacagagggactccagaaattcccttagccactatgcttctagacagtgagaaaatccaaaccactccctttttcaatgcaaggaagttcattccgagacccatctgcaagagtgaaaaatgcgcccattgtgctacctgtaaaaagcatggcaaaatgtgaatgttccttaggatcggacatagggctaaccagaccattctcccagcccagcacctgggacatcaggaagcaaagtgggttgaggatcccatccccataggccttcctctgagtcactggtgcaaagtctgtcctgctgcttgtgtttgtttaccctctttcctgcattaggtacagctaagctttgcaaattaactcacaacaggatccagtgggccttgacccaaaaaccatccacaggagaatgttgacgaggcaacaactgctgcatccatcccacaaaacccctagccacaatgccaagtttgtatccagagtggcgacggtggggacctaaaagctaaaacaagagctcagcagggttagggtctgccatgaactcttaccaggcaaggcagggtggagacacatgtccgtggccctcccacgcactaggatctgtatgatgctcctcatctaagagatgagtttggtttaaatttgaactcaaactgtattcttgtcacagacaatccagagcactctctggggtgtggctctgagacacacaaggaggaaaagacccaagttctacctcaagcagctcatagtctggaggagaaagagctatgacgactgaacaaatgcagaaagtaaatatggaagagtcgagagcactgtgaacattccatctgcagctacctacacttctgaaaagccagactcaaacatcaaagtctctccttgcatctccaccaggatatgtgtgtagtaggcagagcactggtccccaacaaggtccacaccctaattcctggaacctgtgagcatgttaccttacacagcaaaggggacttggcaaatgtgattcagttaaagatcttcagaggggaatttatcctggatgacctgcgtggggccaatatcatcaccagggtcacaagtgcagaacctttcctggctttgggtagaaagagatgtgacttcagaagaaaggcacagaggaatgcaatgttgctggcactggagatggaggaagcgaccacaagccaaagggtacaggcagcctctaaaagctggaaagcccagtaaatggattctcccctgcagcctccagaaagaacacagcactgcaccttgattttagcccagtgagatgtgggtgaccagtaggattataaattgatgtgctttaagccactgtgtgtaatttgttatagcagcaaagggaaaaaatactaataggatgtgtaacaggcatctcaagtctatcatccatctcagccacattagcccctgacttcgttgctgaggccaaacattttggtggcatctccaactctcctctttctctcattctgcacaaatccatcagtaaacccagtacatcccacactctcaccactgccactacaagtttggtccatgccacctctcacctggatgacttctgtttccacctgtgccctcttacaatccagtatcaacagtgaagccagaatggccccattagtccatgtttattatctgccccaaaccctgcaatggtgtttcaggcaagaccttgcacagtcctacaaggccctttagagtttggcctccggttacctttctgccctcatctccttccatccccaagccagcttggcctcttaaatgcttctgaaacacactggaaaacacccccacctcagggcctttgcatatgctattttctctccttggaatgctcttctgcgtagcccactccctttgaagcctctttagggtctttatccaaataccattttttttggtgataccttccgtggcatcatatttaagactgcagccttatctctgacgtttcttgtctccaaggtaaactcaggcctggatcagacagctctgcttttagccatccacgtgaaccaggataaggtatttctctctctaagcctctttttcctcatctgcaaaatgcggttgtggtaagggctgaataccattgtggtgatggttccacaggtatatgcctacatcagcactcatccagctgtgcggtttattgcatgtcaatgcctcaataaagctgttaaattagaaaatgttagtaataataatgacaacaacaataatgaagtgcttagtccacggattgaaacatcttcataacatgtgagacactgttgctctgtggtccagtgtgatgaacaaacaccacagagctttaccagccaagtgcctggaaccgtgctggggaaatgacagcctcgtctgttcctcgtgaccacactctcggtgggtataatgcccacttcacaggtggacaaagtgagactcaggagccacacatgtagaatgttctagaacacagaaagtcctctttccagcatgtccttgtggcagattaggcaagacaaggggggaaaagcagagtccaggggggaggcaaattgagatgcaggagggaaggagataagagcaatagggaatcctcagagcacctggcaggcccccagcccctgggggcaggagaagccaggccacgtagtcatgtccccatggagaatgcagctgctcctctgtgctctgccctcggttgctactgccctgcgaggcaacctcgaggctgggaatctcctcctttctctgtctgcagcagctgcagtgaaacaaagggcacagcccccttcaggccaagagaggtgagaagctgctggggagctgatgtcaccactaccccctccgaagcccatccatggggcacagtgcactccactggcagatcccggaaagggagcatgctgactgactggctgactgactgcctgccacatcaccgtctctgcattgcaattgcaaacactgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaaggcctgtgcctttgggagcttaatttctagtagggactggaggagaggggcatatggataataacaaccaaaaaaaatggtaatgtcacagtatgataaaggctgtgaaagaaataaagtgcaagctagagaataataggagagaactgactgggtagtcagggaaggcctcttaaggagttggcctttaaggggagacctgaagaatgagatggagacaatgcagccatgtttcaggcagaggaaaacgctaagcccatggggtaggcactatggtctgaatgtctgtatccctccaaaattcagatgttaaaacctaatcctcaatgtgatggtgttaggaggtagggcccttgggaggtgattaggtcatgagggccaagccctcataaatgatattcatgccctgataaaagaggctccagagagatcaacggccccttccattaccaatgaagaacaaaacaaaatgatgacagccatctatgaaaaaggaagcaggccctcaccagacatgaatcttctggtgccttgaccctggacttaagcagcctacagaactataagaaatagatgtttgttgcttacaagctacccagtttatgacattttgctatagcagcccaaacagactaagaaagcaggaaagagcttggcacaggctgggaagaagtgacagaaagaaggttgctatgataacgcaatggtgtaatcagtgtgatttttatgtgtttgtatcagagaaccctgggtgcaattcctgtatgaagaattgcatgagcactttgtatgagaatgagcaagttaccctctgtgcaatgctgctctcagcgagcaaataagaatgatcatggaactgaattgatggcacttttgtgcatattaatcaaattgattcatgtaaagtacttaatacaccacatacagtaagtgcttaataaatgccaattactgttcttatcatctccctgcctggttgccacaacagcagagtatattcagggcttagcactgagatctgatttgcctctgtaaggtcccctgttaagtttcttgctgtggttctcactcccaaggcagtcatcaaatatttgttgaatgagcaaataaatcaatgaatgggtttcctgattaccttatctttaagccaccaaaaggcacctttttatgattaggcttcctttgcaagcaatgtgactctgccaggccctgggcttttgcagaaagcgaaggtggaagggagatggttattagccactgtctctgcaaacgacaagccatctgcaccccgttacctaagcatagacctctgtgggtgccaaacttcagagcccagaaagttggaagggattccgagcttggatccctcaggctaggctattcttggaagccgagcaacacgcctgccacagggaaatgagtcatgcagaggctgaaggcttgatggatttctccacggcagcagctatttatcagggtagatctatacaccacagaacacaaagggagcgatggagtacagatgagcgctacttaaagcaatatcaccctcaccttgtattgcagatccttgtattgcagccagatgacaatgcctgggaccctcttaccatccaaacacccacctcaaggaggcccagccctgtcatatgactgtccccattatacttgaacagcctttgaagggctttcaaagtgtttcccagccacatctccaccctccaagctcaggtagcccattccttcattcccgtctcaaatgttctgccccagtgaatatcttcgcctccctgttagactctgagatcttgtactgcagaatccactgttgctcatacaattctgagttgtacctgagggcagaatcagagtggtctttttgccttttgtgtttgcagagtcccaactgcagaagagagtgacatgccataaacaggtcaaatgtcgttaatataaatatctaccatggggcaatttccgaggctcttacatgcttcgtcctgaggttagcatgaggcaactgcactcactgctacgccttcccacacttattctaagggacagccagctaggatggagtgggagctgatgccctggattaaggtgcctggttaattccacttgcctggtttcctttgttctcaaactctgcctggagatgaagctattgcgaagtcagtctcagcttgtgcttctaagttctgctccttacatatgcccccagaaagttgttccaagtgaaggcagcttaattaaaaaccacattcaatcaaactgtcactttgtttatgaaaaagtgtctagtggctggaaatggcaagaacaagcactgaagattaatgctctaaattttttctgattaaaagtatgattgaggcattaagaaagctagctccatgaacccagggcaggccttaagcccaacattttgccatcttcaaatacaactggggatagttgtaaaaacaaatagaacttctctctgcctagaggtttcctttcatgaagataaagtttctagctggaactggctgtttttgcagggaagcacacatgagacaagctttttggagtctctccaatacctgcctgtttcataaatggcacagtctccaaatctgatgctcactggaccagggtcaggctatggaactgattaaaataagtaggaacctccaaggccctatgtccctactctccattttcagattggtaagctgagacctatgtactggaaaaataagctcaagggctccaagtagaaatagttgtagtcctggagtcagccttgggtttagctccacttccaaaatgtgtcaacttatagaacccttattttttcatagggttatgaagccactggtctattttatccaacagagaaatcagctccaagcaaatcccacctggacacagtgtctttgcctgactccagaaacaagatggcactctgtctccagtggttccactttacctagatttggagcctccaaaacattgtatggccacactccatctctgcctacgatggaattatgagagagctttggaaaatggctgttccaaaagtggtagtcttaacacaaagatcaggaagaatatttgatttggattaccagccacagcaggcagaattctaagatgttcccaaagtgatagtcttaatccacaggaagaatatttggtttggattaccagccacagtaggcaaaattctaagatgaccaccaatgacccatgtccttgtgtgatctcctccccttgagtacaggtgaacctgtgaatatgataggacatcgcttctgtgattatgttacatcatatggtaaaagtgacaagattttgaagatatcattaagttccctaatcagctgactttgagttaatcaaaagggagattacccaaggtgggcctggcctcatcagatgagccctttaaaagaaggcttaaaccttccctgtgctcagagactggaagcagcagagccctcctccactctccatcactggttttgaagaaggaggcctctttgagtggcctcctcatttcccatgagataataaatgggtgtcacctgctaagttggtggtcggttgttacacagcaatagatagctgatacacaagccaagaacaaataatacctacagcagtcaagatagtgatgatgtcagtgccgagatgagaaactagcaccagacattctcccacatgggcttcctttaataataataaaatagaaaaatcttcaaaacctaactggcccattttcttttcctgtcattcttttttaaaattaaaagccaacatgggtacccagggctgacttgatcacagcatgattaaatgcacttcctctagaagttagggaaaagaggactcagtgagcataggaagaggaacaagtttctctttgcaaaaacataaaaaaataaaaaattttcaaagaaaacatccaagtctcaaacctcaaacctcaaaccacttcatccaagaagaaacccccacatttgtcatttgcagaagctacagtagagacaatgcaaacaggagctagttctgggtgtgcaaatctgtgacaggtgtgcaaggcacaaccagtccttgcgtgatttcttccaaccgcagactccacgagtgcttatgtacatgagaagacgtgtgtggcccctgggagaagggagcaaccattaggacacaatatttaatgaagtgctaaactgtgcatggctgggtttaaatggtgacctttgagtaaagccagtttgatctcaggacatttccttttcaggaattacttgtatagctacctgatgcagtcaagataaagatctaaatcactgagtaaggcctatgaggcccacgtgctttcaccctgacctctctctaccctcttcccctgctactcctgtctgcatcctggactgaacttaccaaacacgctcatagagctgcttctctttacaatgttcttttctgcacctcacccccgatccctactctcctacctgacgaatttatctttcaagacatgctttataaagtcaccttctctaagaagtcttcttgaattctttctatgaagagtccttagatagccccagcatggcctgtgctcagtttcctcatcttttcaacagggacaaaaataggcattcagggctgagtgtggtggctcatgcctgtagtcccagaactttgggaggccaaggcaggtggatcactaaagctcaggagtttaagatcagcctggccaacatggtgaaaccctgtctctacaaaaaaatacaaatatgagccaggcatggggcacatgcctataatcccagctacttgggggttgaagaaggagggtcgcctggacccaggaggtcaaggcagcagtgagccgagatcatgccactgcactccagcctggacaacagagtgagaccctgtctaacaacaacaacaaaaggcattcagttgtaaaaattaaataagttgacaaatatcaaaggcttagaacctggtgacatgtcttcagcacacagtaaacactcaatgactatttatattctttactgagcacctactaagaaccaaatgttgtgccagccccttgaatacaaaacaggcatagtctctgccctttttcccactcagcactttaagcatggggctgagctcacagcctcatacagagcaaaccccttttcatgtcagtcttgcatataagtgagtcttctctccgaaaaactgctgctgggataaaagacttcctggaacctggggtccaacaccaaggccactaagaccaaaagacaaccccagtctctgaccttatttagaattcctgttcataggcggcaagaaaaagaaagatgtaacaatatgacccccaagaaggatattcccattctctagcaaaatctcattttggaattgcatgttgggtgcctgcctcttactaccatgcctcttctcagctggtgtcatctcctctggggaagtttttcatcatctttgctcaattaggaattaatctccctcatctgacttttctagtatgatttttcattcatgtcttaatcaccacctgacactttatttatttatttatttatttattttctgcctccaacctctgaaatgcaagctccgtaagggtaaaaggatatggagtgagcttaatgttccacaactgggacctaggtcagtgcctgatacatagtagacaacagtctactgacacatagatcaataaatatctattgcataaatgataatagtgttagtagcagccaacactttgatacaatttcctatgcaccaggaaccattccaagggccttatgtatattaactcatataatccctgcaacaactccctgagctaggtactgttgtcattcccatattgggaagaaagaagcttggcagggagagttttggtcacttgttcagttatatagccagtgagttacagagtaaggatttgtcaactgaagaaacacgaggttcatgcatctagaaaggagagctttatttcttataaggggttgcagcctgtaagctgaccatctcgcaggctggggagtgtagcatccagcagaaaccagaggcaggcacttcaaaggaggcaaggtgagacaggaatttatgctaacagaatggctaagtatacatactcaagttataggaggagctatgaatattcacaaaagaagggcacgcaaatgcacagtaaattaatatgaatgtcatatacatgccatgttcattttggggtgaaaacataacatttaagtatactataatttggccccatgtgtcaaaaggtgaattagaggacatgaaggcactcagtgtgcagcccccgtaaactgaccagaaccacttcatgcaaacagaagctagttctgggtgtgcaaatcttatcaggaaggaatgttgcttggttggccgtgtcaaacctgtataaagcgaggggcagagtcaggtggttggttggaaacagtgatggaacaagtcttttgagatggcctgtttctgtttaacccttaggaaagaaagccaaatgatggttagcaagggagaggatataatgtggtaagtctgagctcctgtctggttatggctaggaactcagttttcaaggtttctctgggatccccctggccaagaaggggttccatttaattagttggggtggtttaggattttatttttatttctaggattcaaaccaaccagtctggccccaaagtttatgcgcttaaccacaacactagaatgaattagttaattaacaaacaaaaaatgtcacgtctgtcacattctgtaatgcctggggccatattgggggatgtgcctgtgtgctccacgggtgtcctcttgaatgttataacctctacatgaagcaaaatcctatgtcctgcacacagtaggcactcagaaagtgtttgttgaattggatgacacctgagtttgtgcttctggacattctaaatacttttttatgcaaatctccagctttccttcccatggagactcacagcacctatgcagcaaagtgcattgttggtggtccctatccagagcttctgacaataagtacatcaaagctagggtgccacagtgacactgccatcagcttctgggccacaggaatgctcaacagatgtggataatgagtatggaggagcaatgatgccaaaaataattgttccttgggccttctagatcttctcacttcccctgaggagagattgtgcattctgcctacccaggaggacaggcaagattgcaaacacataagatgtttgtggcaacaactaacagctgtctggccagacttaactgcaagtgagcaaatcccgccttcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcgtaggcatatgctacccctaggctaatccacagacctcggggaagagcaagccgcagtgctaggctgccaagctctaaaaatacccagctcattcccaccatgacactcatggtaagctcttagtgggcaggaatcctgccaaacaaatgcctacctagctggatgatccagaatgagcccagaggctggggactatgcaaacacaggatccagatagggacatggttttctcttgagcatgaatgaagttttaagaaaactggtgtgtgtggattaccatgaattggggaggaggaacaaggagtggaggagaagctcctgctataacaatggaagtcgatgaatgcagtggctaaagctgtaggctcgagagtctgaccaagtccatgcaaatcttgaacctctcacttaataaatacacagcactggggagaaagttaacctctctgagcctcagtttccacatctgtaagaaagggacaatgataataatcactactatatctaccgcattggtttttataaggaatgtaatagattatgttattgttcaaatatctgctgtccctcctctctacaggactcctccctactggacaattggaatcctcgccaatgttgggctgggagccagcggaatgtaagtgggagtgacagtgccacttccaggagaatctttaagatccatctcttcatctacatccttctcttttccctcttccatgagattagcaatgacctagaaaggagccctccgtcagtctgactcttgcatctaagacatgaagcagagctgcaactaacctcatataactggaacaagaaatcaactttcataaacaactccaaaatctcagtagcttattactgtagcatgaacctgcttaaactgactgatacaacagttaaattatatcatctatataagagacttaatgcatatctggcattttcttttttatttatttttgggcagggttggggaacagggtcttactctgtgacccaggctggagtgcagtagcatgatctcagctcattgcagcctccatcggggctcaagtgatcctcccacctcagctttccaagtagctgggactataggcatgcaccaccatgcccagctaatttttttttttttttttttttgagacagggtttcaccacgttgcccaggctggtctcgaactctgggctcaagcaatctgcccacctcggcctcccaaagtgctaggattacaggtgtgagccaccacgcctggccttagcaaattctaagcactcagaaaagttactttattattgctattatcagtatcatcatcatgggttctcacccttttggagacatcccataccttgttgaaagcttttgttgttgtttactcatgaaacctttggaccctctcccttgagaaacgcacatttggacacaattttgaagataagtgcaggtagtttgcacatcccaggctcagagcctctgttagagtctcccagattgaaaaattcatcctaaagtcgatttcctaagcttcggcctggaaatactgccaacatagactctgtgtcatgtcaactgtcactgagcacaaacaggtaaaaatgccacagtgccactttccatcctggacaaacagcccaggacatacagggaggcagggattggcacacatggaaggagagtgctggcccctggctgcgtcctcacctctgtgctcagggctgtgagtgaggatggcagacacaacaatctatacccaccctagacctgcggcatctcttaatctgtgctccacaagatcagcgtctgatcctggggccgcgggctgtctggggaacatgcagttctttagtgtctggatatcattagctaatttgtgtgtccaatttcaaagaaatgtttcctccctagaggagtttctactcaaaggactggctatttttggctcccacccactcggctgtgttgtgcgaagccagcatttcctagactatcccaacccccaccttttcctctctccagagtcagcagcactggagtccaaaacagtctcctgggcatccccatagccttgtattcccatccatctcgcaagaaaagataagtcagcactcttgtagaggacatgcttccaactaggatcaagggaagagcttcattcaccctttctttctcttattcatccattcatttgtttaacaaataattattgacacccttctctatgccccattacatattgtctgtatgacgttgagcaagttacataatgtctctcctcatgcctcagtttttttatctaaaaaatgggatgacaataagaacaacccaagaggccactgtagttattaagtatattaatatatccatagcatttaaataatgcctggcacaaagtaagtgctcggtaaaatgttagttgtactttgtcaactactgtagtaatcaatagggacaaaacggtgagtgaaaactaatacagttcctgcccctacgaagctgatgatccccgaggagaaatatacattaatcacataccctggaggttaaagatatattcagtactccttgattttggtgatggtatcacagatgtatgcatatgtctagattcattgaaacgtttacagtaaatatgtgcaattttttgtatgtcaactatacctcaaagctttataaaataagcacaacaatgaatgttaaatatgtaaccaccataagtgttaccaacgagaagcatatggtgggttccaggagggcagttgatacaggttatggtttaggaacgatttttctaaggagtaatgatgaggttgaggtctggagaatgtctaagaattatgagagagtttggggtatgtgtgcttctttccgggagggttgaggggctctgtttcagacagaagaggcaacatgtaggaaggtcctctcaatatctaacactgttagacatataaaacccttgataataataatcaaataatcagataataataacagaggtctaaacgggaaactataagatttcaacagcaagctgtcttgataaggttccatcatctctcaaaaatttataactaacaacaagacaattacttcccaaatccccttgaaattaattccatcctcctccaggagctatgatgggtgggaaataaaaccgatgagggggaggctcaagtagtagtgatcatatcagagcatatcaaaaccttggtgaatttttactctttagtttgacatggaaattttccctaatcccaagacatagatgataccatgtgataaaaaaaaatcttaagatacatttatccatttattttacagcttttttagtatttaggacctaccaggcattatatgaggtgctaaagacacaacggtgaccaagacacagtctactggtctctgtcccctatactctattttaccatatctatctccaaccctgtcagacccaagagggaggggtttccagtagccaaaaaaaaaatagacccaggcaaaataattttgaaatagaaaaacaatggtgaaggacttacattaccctcatttcaaacatattacaaagctacagaaatcaagagagtgtggtattaagggaaagagacaaatcactggaacaaaactgaacgtttagaaataagctctgacactgtcaattgatttttgacaaacatgacaggataatttgataggaaaaagatagtcttttcaacacatgatgctgggaaaatttgatatcaatatgtgaaaaagtgaacttaaatccttatctccaaaccacacaaaaattaactcaaaatagatcttagacctaaatataacaactaaaactataaggctccttgaaaaaaaaattagagaaaaccatcatgtccttgggttaagcggaaagctcttagacacaaaaccattcattattcttttactagacataaatgaaaaaataggcaaattcatctccattaaaatttaaaacttttgcactccaaagacaccattaagaataaaaagacaagccagactaggagaaaacatttgcaaatcatacatatgataaagaactgtatcaaaaatatataaagaactcctacaactcaataataaaacaaacagctcaaaaataagatgagctaaaaaactctatactcaatagttatttcatcaaagatgaaatacacatggccaataagaaatgaaaaggagttaaacatcattagtcattatggaaatgaacattaaaaccacaatgagattccacttccatatacacactagaatgactataatggaaaatatggacaacaccaagtgttggcaaggattcacagaaactgaaacccttgtacattgctgatggcaatgtgatatggtgcaactacctgtgaaaacagtttggcaattttttaaaaacttaaaacgtaaagttactatatggcccagcaattccacttataggtatcaacccaagagaaattaagatatacatccacacagactggcatatagatattcacaggagtattatccctaacagacaagaagtagaaataacccaaatacccatgagctggtaaataaacaaaatgttggctgggcgcagtggatcacatctataactttggaggctgaggtaggtgatcacttgagccaggagtttgagatcaacctgggcaacatggaaaccccatctctaccaaatacgtatgtatgtgtgtgtatacacacacacacacacacacacacacacacacacaaacacacaaaattagctgggtgtggtagtgtatacctgtagtcccagctactcgtgaggctgaggtgggaggattgcttgagcctcggaggcagaggctgcagtgagccacagcctggggaataggccccatctcaaaaaaataaaaaataaacaaaatgttatatatccagataatggaatgttatttggaaatagaaatgtagaaaacactgatacatgtgacaacatgaattaacctcaaagacattatgctaagtgaaagaagccagactcaagagactatatattgtatgattccatttacattaaatttccagaaaaggaaaatctatagagacagaaagtggatcagtgcttgcttggggctggggttaggagcaatgattgacaggcctgagataatttttttagggctggtgaaaatgttctaaaatttatttggggtgatggttgcaaaatctgtaactttactttaaaaatcattggattatgtatttacaatgagtgcattttatgataagtaaattatatatcaataaaggtattaaaataattaatcctctaacagcccacacaatagtttagtcatctgcatgccttgatatacctccagtctagtcctttcaacaaagaatagaagagtttagtcaaatgaggagtctttgggattggaatggttctagcctcattctctaaataattctacccaaacaatatttaggaataatttttttagagtggcataaacaccataattacatgcacatacttttcatcttttctgttctagaaaaggagtcttcttacagtccaaggaaaatcagtctctacactgaattataaattaacatttcagcagacatgcaatgttgtgtgaggtcttcccacgttagcagtcggaatacaggggacagcatcacctcctttgcctccagaggtctgagggtgcagtggaaagagatcagggtgtcttcaagagtttgaatttctctcttctcaagaatagaaggaaaattaagcattatttttttctctcaatgattttgccttttataataagtaactcttatagactccttactatgtgacatgccctgtttcaaacatataaaatatattaactaatttaatgctcataacaactctatgaggtcagttctattttatcccttttaacaaataagtaaactagagcacagatgggttaagtgacttgtccaagatcacacagcaagctagtagagacgggattcaaactaaacggtaactcaagtcccttctcttaagccctccatctcatgtactcagaggcattaaatctcaaggtatacataaaagataaggtaaaaggcagcatgaaaagttgctttttttttttttttttaacaggctggagtgcaatgccacaatcttggctcactgcagcctctgcctcctgggttcaagcaattctcctgcctcagcctcccaagtagctgggattacaggcacccaccaccatgcctggctaattttttgtatttttagtagaggtggggtttcgccatgttggccaggctggcctcaaactcctggctcaagtgatccacccgcctcagcctcccaaagtgctctgattacaggcatgagccccacgcccggccaacctttctgaaacccagaagaaagaagagcaagtggggctcagagtcacagttgctcagcactgcaggcagggtccgtatgtcataataacagatggggtaggtaccattgctcttgcagcctgcaggtcccaaaggaaattgtgtcattttatcttgcctagctccaaaaggagcagcctctgtcagaagatctcaatcatcataggcacatcccaggtgtgtgtcctgcttctcatcaggcctccccatcttactagaccactaggttcagccctgacttgtaggaggggctgggcctccatagcttctaaaaacatacagttaatctacagcatctctcctacatttgctgcgtagcattggcaccttcactcaagtgacagtattatagtcaggtggcatcgatcagctttaatcagccttatatttaagagctagagtctctgggtgttttagggaatacccgggcaacaaagtgaaaaaaaaaaacaaaaaaccttttgcagtagattgcatgattgcacaactggcccaattcttcatctcttactggaaacatgtcactgtcacgtgattctgtggtccctgccacttaagaaccaggatacagttcctcacctcttgactttgagtttgatcacgtgacttagtttggccaattacgtgagggagacgtgccagtgtgccggttttggcttttgcccagggtgtctaagaccgtagggaagagattgtctgggaaactctgcccaagacatcaccagagagcccacgtagtgtggtttctctccttgtatcaatgagaatgaaacccaaagagaactgatgcatcacccagtgagtgaatataggagctacagtgaaacccatgtctcctgtcctcctactccaggtttctaaacaggaagcatcagaacctggctgtcagaaaaataatctgaggccccaaggtttcatggagcagttactctctgctcagcactaagccacgtgtacagaggagataccaataaggaaaatgactgggtccctggttataatgtcctaaatctgtaatggagtgaatcaacaagacacttgcaaacaaaatggtgagggctcaggaggctgtaatttttaaaaagtgctggactgaggaaaggtgagagttacaggctcagttctgccactcgcctgctgtgtgactttgagctggtcattccctatctcttaataacagcttcttcatctatagaatgtgggtatacatgaggggatttttttagaactctagttctcagttctgactgcatattattctcaccaagaaaacagttttttttttttgagatggaatctcgctcttattgcccaggctggggtgcaatggcacaatctcagctcactgcaacctccacctcttgggttcaagcgattctcctgcctcagcctcctgagtagctgggagtacaggcacccaccacaatgcctggctgatttttgtatttttagtagagacagggtttcaccacgttggccaggctggtctcaaactccttacctccagtgatctgcccgcctcaacctcccaaagtgctgggattataggcatgagccactgtgcctggcccagaaagcattttttaaaagaggaacccagacccttggagaaatgactgattgctgattccagggttgaagcaggaaaagtataaaatgaaccaagagcatcttattgttccagaaagtaagggaatgtgcaccaaaaaaaaaaaaaaaaaaaaaatgaggacttctagggatggaattttgtcccctacaaattcatatattgaagccttaacctgccattgactatatttggagatagggcttttaggaggtaactaaggttaaatgaggtcataagagtaggaccccaggttgataggactggtgaacttgtaagtagaggaagaagagagatttctctctctctctctctccaccagcatgcactgagaaaaggccatatgagcacacagagagaagacagctgtctgcaaaccagtaagagagcccttactcaaacccaaccacgccagctccctgatcttggacttccagcttttagaaccatgaaaaaaataaatttttgttgtttaagacacccagtctatgatattttgtcatggaagcctgagctcactaagacaagaatgtgtcaaaagaatacaagagccaggttgaggtgctgaccgataaaatctgagacaatttaagcataaatataaataacgacagtaatggattataacccactgtaaaattaagaatcttgagcccatgctaatataaagtataaaagtaaaaataaatgttcttccttatagcagaacactagtaaagagaaggaatgatggagttagaaaacatcaatggatgctaaagctggtgagtaaaaacatgataaggaataggatatttatatagtctcaatgtatctgcctaataatataggagctacattgaaagtgtatcccgtcttcctagtgcaggtttctaagcaggaagcatcagaacccagcatcagaactccctacaagttacttgttaattacaaagaggaaatagcaactttacagtagagactgcagatactaccttaaccacggagtcaaaattaatatcaccaatatcaagaccaacggacatcatctcttgatacaatgcaccaagaaggacacaatatcacttcagtgatattcctacaaaaaaaaagtgtgaaagaaatagggcaaaatgtaagcaactggtgaatctgaataaagagaatataggagttctttctactattctttcaacttttctgtaagcttgaaaatatatctactcatgacacaagtttacctgtgtaacaaacctgcacatgtacccctgaaataaaaagttaaaaaaagaaaatatatctaaatgcatatacagtttaaaaaacatatgagcccaagccccaccccagactaataaaatcagattcactgggggtttagggcccaggcatccatgtttttgtttctatgtttgttttttaggctccttgggtgattctaatgtgcctcctaggttgacagcccctacgggactcagaggatagtgacattctgacattctctggacctgtgggtaccaaagtaaatggtttacagcagttcccaaccagcagcagcacctaaccacccggagacttgtaacaaatgcagattcttgggcctcacccagacctactgaatctgacacttcggtggtgtaccggcaacctgtgctttaatcaggcatctcggggtttctgatgttcactaaagtgtgagaaccatggtctatattgattctcaggtaactaatagtgttcttctttttcaattttttttaaattgtggtaaaacacacacacacacacacacacacacacacacactttactctcttggccggtcagcatagacttccagccccacatcacctttcccaaatgtcttccaaggggcaaagtccagacacaacagtgaaagtgtggattttactccactgttctaactatcagttctttcttgctggtggtctcatttccctgccctcctccttacctgtgccacataccccattctccttgtacttcccctactggtcagtcccccacacatagacctgctacaaccacaactaactccttgagactaacctgtcctctccatcactctcaagccacattctctgagcctgcccaggagactaagaaccaatgtggaattaacaatttactgaaaaagaccagatccctttcccaggtgtgaggctatagcacgggtgttagctgtgataatttttaggtggtacaaggagactgaattaaataacatcaagtcacatggtgcaaaagttgctccctttcaagtctgtttcaactcttctgaaaacatcagggaaaaagtcccaaacaccctacaacactcgctaatctccctttttaacagcgagatcaggcctcaggctctgagccttaggcagcagtctctgagctgtttggtcttcgtggtatatatttttgcaacttactttctatttgtgggaagtgatactggttttccatttctggctgtgatgccaagttgctttttaaaaataaatgtgcttaaattaaaatgcaagtggtttaaagcacacactaaacaaataatcgtagagatgtttgaagttggaaaacagagaatgaggacccgggcttcttccctgtgaaatcttcaccctacatatatcattttggtgtcttggagactgcatcctaccatgatctcatctatgaagcaacaggaaaggaatggagtctccagtgagattggatcagcagtttcattagaggggctggcagagaacacttttgctcttcctcctggtccctaagccttcctgaaacccagggactggaaagggatcctaaccaaatctgcagctattggcatatcctagatcctagtgagccagaggtgggcagtggtggggacagggatggctgataaatgtgggcagatccctaaactgcatccgaccctcctgcactttctttcttaagacccttcatctaacatgtaggagaactaaagtggatcctcatctctcaccttaagcaaaaatcaactcaaggtggatcaaggacttaaatctaagacctaaaaccataaaaattctagaaggtaacacgggaaaatcccttctagacattggattaggcaaagatttcatgaccaagaacccaaagcaaatgcaacaaaaacaaagacaaataggcggtacttaattaaactaaagagcttctgcacagccaaaagaacagtcagcagactaaatacacaacccacagagtgtgagaaaatcttcacaaccatacatccaaaggactaatatctagaatctacaaggaactcaaacaaattagcaagaaaaaaaaacaattagcaaacaaattagcaagcccaaacaaaagtgggctaagggcatgaacagatagttctcaaaagaagacgtacaaatggccaacaaacatatgaacaaatgctcaacatcagtaatgatcagggaaatgcaaatcaaaccacaatgcaataccactttattcctgcaagaatggccataatcaaaaaattaaaaaaatagacattggcatggatgtggtgaaaaggaaacacttccgcactgctggtgggaatgtaaactagtacaaccactatggaaaacagtgtggagatagcttaaataactaaaaggagaactaccatttggcacagcaatcccactactgggtatctacccagaggaaaagaagtcattataccaaaaagacatttgcacacacatgtttacagcagcacaattcacaaatgcaaaaatatggaatcagcccaaatgcccattaatcgacaagtggctaaacaaattgtggtatgtatatatacacgatggaataaaactcagccttaaaaaggaatgaattaatggcatctgcaccaacctgaatggaactgaagactattattctaagtaaagtaactcaggaatggagaaccaaacattgtatgttctcacttgtaagtgagagctaagctatgagaatgcaaaggcataagaatgacacaatggacgctggaaattcaggggaaagggtggtgaggaataaaagactacaaattggattaaatgtatactgctcgggtgatgggtgcaccaaaatctcagaaatcatcactgaactactcatgtaaccaaatacctactgtcccccctcccccccccaaaaaaaacctatggaaattttagaaaaggaaaaataaataaataaaactagtattgatttgggttatttcagtttgtgttctccaaatagttgttaaaaataatttagaaaatgctcaaaaaaaccactcatctagaggaatttagatcacagcaaagaaatttctaacattccccataccttgtgcatctgacctatgatttttttccttgaccttaaaggcttacaaagggcatcattatgagtaactgcaaaaccattatgaaaatcaactccctattttggatgactccccatgttcagcataaaagatacttactcaaaagcttggtgttttcattccagaagaaactccttttaatgctgcaagcagcattacaattttacaagagaaaaataaaacattcttagtaattaaatgcaaatcaccagagctcagaattcagggccctgtctctggagtgcctagattcagcactgggagaagcaaataactgagagaaggaaagagaatgccatcctgtctccctcccttgcacccccttcctcagctaactagtgttcccctggctcaaagaaaatgtggaagttggtggtttttcacaaggatgatactatctggagctgctgtcctctgagagtaggacgggtcagaagagatctgcacctgctctgttaaggtagtcttgccatctctaagggtttgatttgctggcttgtttactggagtcagaaacagaataaaggtaactcacttcaaaggctagattcaaatgctacttcctagaagataccttcaggaccctccttcactcccaaatagaaggaactctgctttttcaacatggtattgaagtcagaatgtttgttattccaaacaccagtactgaaacgtctgctcattccgtgaagttcctgaggtgccgagtgctggggatataacagtgaagatggataattctccattcttacggagcttcattgagggagctcagggaggcaggagttagtcaataatcacaaaagtaaagcaacatcacaaattgtagcgagtgctatttaagtacatgaaaacaatttactagtcaagaagtatcagcagaatgaacagcaggtgcaaagggcccatgtcagacaggtgaaggggggacatgagggcaactgcaagaaggccaatattacttttgcaaggagcaggtgagacgtggggctccagaggtagccgaggtcagccatgaagtgcttggaaggccacagagacaaattttattcctatcaccatagcaacgggaagccatgaaaccgttttcagcagagaaacaacatgatcgggtttgcattttgaaagatcccactggcttcagtagagaggatagattttgagcaagaagcaaagatgcttgtgcaaaggagagtaattcgaagacctttggtagtcctggcaagagatgttgagtgttggatcacagagctgctgatggaaatggggagatgtatttcgactgatgttggtcaagttacttctttctgcacctccatttcctcatctgtaaactgggagtaataagcccactcacctcccagtgaaatgagatggcatgtagaaagcacctggcacatcctgatgattcaataaacgatagtcgttgttatagtgatgatctttgtaactcttgtaagatgcttttcagttcacatctttttaaatgattgtctgtccacactgttcactccatctgtgcagctttatgttatttgaaggcatagtgcccccctgctggattcactttataacaatcagttctcccaccaggatgattagcgcccagaaagtgtaagtaaatatttgtggagaaaactgatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccgcttttgagctgaggtcacattctgccagagcagtcctcagccagtgacagggcatgagggggacatggggcccggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaactggctcaccttggagagaacagaaactaaaagccacaacatgaagcgtatacaagaaccaggtaagttaagtaactcagagctatctcttgtcccaaaggatgaaaacctccgagcgccgtggaagagaacagtctgattaagttggctcaaactgccaggaagctttctgagcaacagcagatgttggggcttcgagaaagattgctctctgcttttggccagaatccctggggtcatttaggtggtgatgttgccagttcttctcccctctggccaacacctctcaatccattatttgggataccaattataaacttgggacaagagcctaatctcccagcaaggaaaacctgggctgtcagtctactttaccaatccctgccttggaaattgctatatatctcaggctacaagaaagtagagggagacaagagaaaaagcatccctcacacaaccttcagatcttccgctggagagatagccccactctaggagggaatggttattgctataatttgggggatattttggcaggtttgggaaaatctattcaaagtttagtttagtctcaatttctagaacatcgagccacttttgtgtaggcaagggtgacaggaaaagctgaaaacatggtggtaatcctagagataatagtaatagcagtatttatggagcaatgagtatgtttgtagattgagaggggtattttttacagaatcagctcatctaatcatcacacgaactcctagacattggtgctattttcaccaactatttcaataaggacacagaggttctgatatggtttgggtgtttgttccctccaaactcatgttgaaatgtcacctccagtgttggaggtagggcctggcgggaggccattagatcatgggggcagatccctcatgaacagcctagcaccataaccctggtaatgagtgagctctcgctcttagttcacatgagatttggttgtttaaaagagtgtggcactgatcccctttctctcttgctctgtctttcaccatgcgatatgctacccccctttcaccttccaccatgattggaagcctcctgaggcctcaccagaagccaagctgaagccagcaccatgcttcctgtatagcctgcagaaccgtgagccaattaaacctctcttctttacaaattacctaatgttgggtatttctttcttctttttttcttttttttcttttcttttttattgggggggacagagtctcactctattgcccaggctgtagtgcagtgttgtgatctctgctcactgcaaccttcgcctcctaggttcaagcaattcttgtgcctcagcctcccaagtagctgggattacaggcatgcaccaccatgccaggctgccttgggtgtttctttatagcaacacaagaatggactaacatgggctcagagaggttaggtaacttgtctaagaccacagagctagcaagaggtagagctaggattcaaacttaggtctctccaaaatcaaagactacatttatcctcccttcctccactgttctagatcactcttgcactggggcactcttgctctgagagacgtatcccactcacagacatggagtggatgcctcggttgctgcatcatttaacaagcatctattgtctgctctgtgccatcccctatggtaggcactgggacgaaaagaatgaatgatccttgacatcaagaagctcaaagactagctggaaagatactaatatagcaattccttttattttctctaataggagacccactcgcaactatgaggaatagatactatcagcagcaacagcaactttttttttaaggacaaagaaagtaaatatgggaaaatgtaaacttgtccaaagacatacatctagtcatgagaaagctgaaacccaaaacagctaagctgatgtatcacagcctctgaatcaccatcactgaaagaaacaacacacttggggatgggggagtggctctccttgcacaagctgggatgcaatttgcagacattttgcagagcagaaaatatatgagtctctgaagggcagtgatcaatcatttcagccatcttaaatgagaccagaatagatacaagaagaatctcagccacatataactctaaccatcaagggtattactaacccccaaaatatttcatcttcttgaagttttatggctatggctcttgagtgttttgggggtacagggagatatgggtttaggcagctgaagcaatacctatctatagataagaatatcgccagaagtcctaataacctcagaaaatctacaaaacaagagagtccatatgtatgccggaatccctgcccctgacatgtttactctgctgactacctccagtgacagaactctagacttaattagccagctcatagctcttccacatactttttggaggtagattttgtctctatgggctctacttcttcccttagattctagagcaccatggaatgtatctgctctatgttcaagatgaaagcccttcaaataattgggtatagcaatctactcacccctctcacttcctcatttctctccactctcagaaatgcaaacatttatccttttgttgatgttattcaggaaccacttccagcagcctgtacctcccttagtcatgttccttttaacaagctcagtttatcaatgtccttcttaaaatacagaactcacacatgagcataaccgaagatacaatatttgtgaagggactgtgaaaacaagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccaggagagaaaagagaaaagtggatggatatgaacactatgtagaaggtgtagtcacagggcgaggggtgtgagggaaatggtggcagcaagaagttgagcctgggcatctgggaggatggtggtgccatgccctggaggaggaccagtttgaagaaagaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagcataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccgagattaaagcagtgccactctgggtctggagccgaactggtagctggggtctagaagaattcagagttcatcccgagtcttctctagagatggaagcctggagaagcctggagaagcctggggaagccagaaggccctgaacccctgacaaaaagcctaaggatcctcacccagcaatgctgaccacgaccattaaaacatgaagcccacccccaaagaggaaaatccttgccctttaatgaagctgccaaaaacctccaaatttaacagtttgcactgtgtctttctgcagacacagaaaaatgagctgggaaatagaacagtcacatctggccaagagagttgtggacttttgaggtgttgcctgggtctcctgggcagtagaatcagctgacccaatgtttaatagagaaactacaaattttcaaacataagaaaaccatgtaaaaaaaaaaaatcaatgggggagggggtgtttaaatgcatttgagaccagccatatgacagcgatttggaagcccttataacccttagttttaataacataagaattccctatgaaattctaaataaggctgggcatggtggttcatgcttgtaattccagcgcttaaggaggctgagttgaggtgggcagatctcctgaggttaggagtttgagatcagcctggccaacacggtgaaaccccatctctgctaaaaatacaaaaattagctgggcatggtggtgcgcacacgtaatcccagctacttgggaggctgaggcaggagaatggcttgaacccaggaggtgggggttgcagacagctaagatcgtgccactgcacgccagcctcggtgacaaggcaagactctatctccaaaaataataattctaaataaagcaaaataaaatgtatgcataaacatatatatgcaaaggtatatgtatatgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataagatgaggcatgcgtacttccccatctgaaatagccaagatgatgaccattcttataagtgaaagagttttttttttttgtttggggaagtgtttttttttttctttttatctttcattcctgttcaaattcttttttaatttacacataagaaaaagtggtctggcacagtggctcacttctgtaatcctagcactttgggagactgagagggaggactgcttgagaccaggaattcgagaccaacctgggcaatatattgagaccctgtctctatttaaaattgttttaatttaaaaaaatttacaataaataaataaaaataagaaaaacctcccaaatcccaccactctagtacaaccaaagtggccacaccatcacacgtgaggttgttcacagcatccttctctggggatgattctaagtcccttgaagatagggagcgtgactagtttgtctctgaatccctggtacctggaagtggcctgacccccagaaggcactccgatgacgtctgttgaatggatagatgagaatgcacataagaaaaagtgatttttttcctaacaaagtaaaatggcattccacggactttggggaagttggctccttcacttctagagaaaaaaggagaataaggcaggaattcaaaatactcttatgaacagaaaggcaacaggtagagcaggacatggagggattcatgaagggagagaaggaaggcagggaagctgggctgtgcaataagcagcaagcctgggtgttatttcagcctcccgagaacatgccagaatagacattgccattacctccattttcagaggaagaaactaagacaaatgaatcagacagaagacatgatgttcatctcataaatggacatgtggagatttgaacccagctcagctggctttgaattcagaaatctttacccctaagggacatcatgaagcaagacaaagaatgaaatggagggctaggatgatgactggatttcctgctgattgaaggaatgttgaaccaagcacatgtacttcaatcctaaccatacacagggaagttctttctgtatttggaagagctaagcggaagatctcagcactagtcccagcccctgtgtccatgccatttcagcactagataacaagatatatccatgtaggaagatggatgaggaaagcagggtggatctgtctcccccaaaggaaaccacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacacgcttctgtgaagaaaactgatattctgctggggtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgggggtacagaggtgcacaaaacgtgcaaagtgcctgctacagtgatgcttaccctctggtggggagagctgaagttctgggaaagtacagtttgagggaatgcctcatatgcaaaaggccaaccctgggctagatcctactcatgtatgtctcatccagttcctcccaataatcccaagattaggtactccttgcatcaaatcattttaaagaagagaaaattgagtgtattagtccattttcatgctgctgataaagacataactgaaactgggaagaaaaagaggtttaatggacttacagtaccacatggctgggaaggcctcacaatcatggtggaaagcaagaaggtgcaagtcaagtcttacatggatggcagcaggcaaagacagagagcttgtgcaggagaattcctctttttgaaaccattggatctcatgagaccttattcactattgtgagaacagcataagaaagatccacccccatgattcagttacctcccactgggtccctcccacaacatgtgggaattgtgggagttaaaattcaagatgagatttgagtggggacacagccaaaccatatcattgggtctcagagaagtaattgcctcaagaatcacacagctgacaggtaacagagccagaactcaaaccccaggcctcctgatcacagctgccatgttgcacaaccctcatctcagaaggaatcagaatttgtgttcacggttacacgtgttcagggtcacacacttagtgtacgatgtagccggggttaaagctgagatgagccaactctagaccctagtctcttaaccactatagatactgctgtgctagcatacttggaaaccaccatatatgttcttggaaattcaccaagcacattaccatgttaggcagacttattactattctgcagtatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaagacatttaggctgagaagctaattaagaaataacagagaaaactaatgaaacccaaagctgattctctttaaaaaaaaaaaaaaaaaaaaacaaaattgataaacctaggtagactgatcaagaagaaaagagactatcagaaataaagtctggtgcattactacagactttaagatattaaaaggattaaaaaacccttatgcctataaatttgacaacctagatgaaatggacaaattcctggaaagatacaaattaccaaagctttttcaaaaagaaatagaaaccttcaccaaccctgtatcaattaaagaaattgaacccatagtttaaaaccctcccacaaagtaaacttcaggcccagatgtcttctctgctgcactctataaaacatttaaggaaaaaaaaaaaagagtcctacacaaattatttcagaaactagtgttcagaaggcaatacttcccaattcatgttatgaggatagtattaccctgattccaaaaccagaggaagccattataaggaaactctagaccaaccttcctcgcaaacatacatgcaaaagtgccccacaaaatatgagcagatcaaatagaaaaatgtaacaaaaggcaatgcattataaccaagtacgttcacaccatgaaggtaggctgaaatccaaagaacaagaaataaccagattacaaaaaaaaaaaaaataggaagaatgaataagacctaccatttaataaatggcacaacagtgtgactatagtcaataattgaacatttttaaataacaaaaaatatataattggatcgtttgtaacacaaaggataaatgctcaaggggatggagacctcattttccatgatgtgattatttcacattgcatgcctgtattaaaacatctcatgtaccccataaatatatacacctactatgtacccacaaaaaaaataaaattttttttaattttattattattatactttaagttttagggtacatgtgcacaatgtgcaggttagttacatatgtatacatgtgccatgctggtgtgctgcatccattaactcgtcatctagcattagctatatctcctaatgctatccctcccccatccccccaccccacaacagtccccagagtgtgatgttccccttcctgtgtccatgtgttctcattgttattaaataaaaagaattttaaataaaaacagaaataacctgtcaagtgaagaacaacaagaaagttctgggcaaagggagtggcacacgcagaggctacagggtaagaaagagcttggcaaatttgaaaagttgaatggaaaccatttggaatagcatttaacgagttaggggaacgtggtaatggatgagactggagaatagacaaggctagatcacacaggacctcatcaaggtaaatagtttggattttttaataaattctaatggacgctattacatggtttttacctggggaatgtcgtggaactgtttgttttaataaagatttcttaacagaatatggagaagcaagtggcaagggggcaaagtggaagagagataccaatgaggaagctattggagtgatccaggggagtgatggcgccagccaggactggggggtgcatgggcaagggagaaaagtgggtaagtcaagggatatttcaaagataaaaccaacaggatttgctgacagactgcaagtatgagataaggagaaatcttgtagcaggttctggataagtgatcataaatcctactccgttttcctcctgggaatatttagtccataaaaaacttcccaggctccactcctttcacagctcaacacagatgatgtcagtggccttagaagccatatgttgaaggtggcagaaccaaaagatgaaaggagctgagcccctgaatcgtcacttgtcagagggccgccctctgaatacaaacatccacatttgacttcagacgagtaagaagtacatctgtggtggattcagtttctgctattcagggatgtatgtgttaaactaacttttcttaacctaattacttcagacaaaaatcaagaaaaagctagtatatcagctcgaccaattaagtggagctaagaatactcttacttcagctcttaaaagaactgattgaaatgagacagtttggaggctttcaagggatttgttcaattccatttctaaaaggaatctatactgagaaaataacagtaaatataaaggtttatgcacagagatgtttatcagtggcatttatattagcaaaagtttccatgaaaatgaccaaggcacccaacactaagtggttaaataaccaccactatgggcattaaaaattatgcttacagttcccaggcccacagcgtcagcagcagcggcagcagcggcaggcggccgcgcgggtgtttgtcgcttcgcggggccttgcggcagcatggcgaaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctgtggtcaatgatcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctgcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcggcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcaggagagctcaaatttgagaagtggaccatgtcagcccagatcgagggtggcgtccatggcctgcacgcttaccagaagcagctgtactgaggatagcagtggaggatgaggtggtggagggagcataccccagtgtccaccttcgggcacaacctctctccataactgagtggtccacagatttgcactacgggttccccagctcctttccagggagagaggaggagaggtcctgaaggctctgcagcccctcgctgagcatcccctacagagtcgggcctgctccctgggccaggctgcctgggggcgccccccagcccagccagccaggctctcaggccctgcgcctgcctcaggtctttcttgctgcagcatgctccagcatggcccccaccccagggacaggaggccccacctggcttctcctgtagggtacctccctgcccccagcccccccaggaaatggtgctttcctggctctgcctctggctcttcccgggccgctgccccctcagccatgtggcacttctgagctcctgacctaggccaagaggaggtctctgcccccttccccggtcctgggctacccttgggtcctggctccttaggccattcccctgtccctggccccggggaggaggctgccctgctcatggccgcctgcccatcattcgtgactcaccaccgtccccatataccattcctgccctctcctcagctgcagttgaaggctttaactttgcacattttgggatcacagttacatcactgtgtattaaataatcagaataaataaaaattatgcttacagagattttgatagtaagtgaaacatgcagcttatacactactgcatgtataaattgtgtgcaattacaaataggtatggatatatttatatcttatgtacttgtataaatacagatacatacatacacatgcacatcaatgcacacatatatatgcagaaggaaataaatgggaaaatgccattattgtttaatatgtgtgacagcgttattgagttgaaaataaaatacactcagcattatttttaacaaatttaaaagactatttcatgaccttgaggagtagagtcttgaagggcatcttaagatttttaaccttagttgggcatggtggctcacacatgtaatcccagctactcagaaggctagggcagagttcaagaccaacctggataacaaagaccctcgttcttaaaaaaaaaagaaaaaaaaagatttaattagccatgcatggtggtgtgtgcctgtagtgccagctactctggaggctgaggcaagaaaaattgcctgagcctgagttcaacgctgcagtgagctatgatcatgccactgcactccagcctgggcaacagagcaagaccctgcctctaaagacacaaaaatagaaaataaattttaaaaaacaaatccttcataaaaccacacagtgagactgtgctctgcagcaatgccaatgctaaacactcttagaaaagccccacaggggagcctgcttggaaactcaagagagagttgaagaggttttgatccacccaagagattatgtgcgggtaaagccaaaaggaccccagactcgaagatgccagcctgggtgaaatgaaccaaatcaagcaaagcaggcagatgctgtaggccagtcgcccacagaagaatcataacctttcaaagcagattgtgtaaacacaggagagggaggaggaagatgtatcttctgtgtccccagaaacccgcaggcaccggtcccagcgatcccaggaagtgaatagctagtttgttttgggtagctaagaacactgcccactcaaccaaaataagagtgacttcttcaaaaggttatgaacccactgatttctgacagtatttcccaagaaggcaaacagagcccaaagcctgtgcttaaaaagctagtgatctaataaccaaagaatcacaaattaaagtgtcctatatgagccaaataggaacactggcaaaatagagaatttatgcttcatttaatggggcaaagtcacgcccccgatgtgccaggtctgcatgctgttttaaaaattttttgtttagatattttctatgtaaaactaaggttatttcacttaaaattccaattttcagtttcttcctgaaaacatggaagaactgtcaacactggacccacgtccccacatggcattaatccatcaactggcctctttcacttgtttaaaattattctctggttcatttaattttttgagtttgcagcccttgctgtgcatgttccttccctgcttaaaatgtgctgctttcaatgctctgttgcaattgtatataaagtaaaagtaaactagcctggagagacagtcttaagacggctctcctttgtgtagaatacatggactttgttgaccactcttttgcatgatctaagtttttttttttcagcttactttgtaatttccttatggtttcaaaatgctggagaactggtctccaattagtgaagtatttctgggggccttctttaaagttacttgctataccatcaacatagtatttgtatgttttcatttgtaggtagtaggagagatgcttaaacaggaagagacagaagctctccttgttgaccccactcctctcttgtcttagatgccagaaacctatctggaggaggataagcagagcatccatccatgtgcacaccctggggcctgcgcccccccataaatcattatctgaaccaacaggataggctgctgggacacccactctacttatcagagcccagcagttgtgcccaaggcaacagcacctgaattttataattctgcaggtgaaatttagtgcaaaccagatattcctgagacccaacttggcttccgcaactgtattctcaagctgaaaacattttgtgtgaatggggtatgggggcgtggggacactgtttctcagaagccttcattatttcatttctcaagcaaatactggggatggaaatatggagcataattactcaggactttttttttgttttaagaatgaccagaaatagaaccatgaacacttttggtgggaatgtaaattagttcaaccattgtggaagacagtgtagtgattcttctaagatctagaaccagaaataccatttgacccagcaatcccgttacagggtatatacttaaaggaatataaaccattccgtcataaagatacatgcacacgtatgtttattttagcactatccacaatagcaaagacatggaattaacccaaatgcccatcaatgatagactggataaagaaaatgtggtacatacatattatggaatactatccagccataaaaaggaatgagatcacgtcctttgcagggacatggatgaagctggaagccatcatcctcaacaaaccaacacaggaacagaaaaccaaaaaccacatgttctcactcataagtgagagctgaacaatgagaacacatggacacagggaggggaacacacaccagagtctgttggtggtggggaagggagagcatcaggataaatagctaatgcatatggggcttaatacctaggtgataggttgagaggtgcagcaaaccactatggcaaatgtctacctaggtaacaaacctatgttctgtacatgtatcccagaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttggaaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccatatgcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtgactgaaaaaaaaaaaaaaagtagctaagcttactccatgcacaggtgaattcaggacccaaaatctgtcatctggatttcgtgttcctccttcttgctgttctgctgccacacagttggctctagttgttggctccaattcttggctccaagtggaagcaagatggtagcagtgattttattccctacatcttttcaggttcacttttaatagaaaataccaagtcttttcccccaggagctcttatctttagagacgcatattgaaaagtatagagatgaaatgataggatgttgggaatttgctccaaaataatctactgtgggtggcgataaaatgaattaagattgtccatgagttgataaatgctgaagctggatggtgagtataggagagttatctctgcttatgattagagttacctctattttcatgcattttggaaaatcatcataataaaaagttaatttgaaaaaagaatctcttttactcaagtttgaggtaaagtctcatttcacctcactgggtcttcctggaccagataaccatccccgaactgttcacagggaccaggagcatataatgaccacattgttccagcactgaaccatatgctccatctctgcaccaggaggaatctctacaaaaagctcaggggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcacaagtgacttggtctgaacaatgagagggagaccctggtgatgggtgcagagatgagcacatggcactggaccagccaatgataatcttggggcattctctggagcccctcttccttctgaggtggccaagttgaaggatgaacatctgttgtggctggtgttatctttgccatcacttaaggagaatctgccaaagactgagtctgacagaggaaagcggagcccaggtacaggaagacgttctcgaagacattgttatatatctgtattcagccgtgctggaagccagataccctgaactttttagttacctgatcaaataaatgttcctgtttggcttcaggttctcatttagactcctgtcacttatatctctggctaataaagggaactatggtcacccccaccccaccccacgcagcaattgtagtttttcccgccccgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagacagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaatggaagatcagcataaacaaagtcacattcaggccaggactcttaagaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccatcatcctttgaattacgaagctaagggaaaaaaagcccattggctttaaaacccagcagaattcagtaggaggaggaagatggagaaagttataaagtaatcaagttgggtgggaacctcaggttagatcctcattacacttagaatgagcgttacccatttgacacaggtggatatctttgctgttactcaaagccaagaggaaggtattttccagctttatttgatgagttgttttcatgcttaatattttccagaaatctgttaattcatacaggtaagagactgtgccttagtcatctctgtagcctccacagcccttcataaacagcagattcaaacaaacaaaagcttcattcaagaaaggaaggaaggcggctttttgtctagccccgtggttctcaacagggaaagattattttttaactttcattttaggttcaggggtacatgtgcaggttatataggtaaactgtgtgtcacagggatttggtacacacatttggtacagattattttgtcacacaggtaatatgcacatagtacctgacaggtagttttttatcctctccctcctcccaccctccgccctcgattagaactatttgtctgttgttcccctccctatgtccctgtgttcgcactgtttagctcccacttataagtaagaacatgtagtatttggttttctgttcctgcattagtttgctaaggataatggcctctggctccatccatgttgctgcaaagtacatgagttcattctttttatggctatgtagtactccatgctgtatatgtaccagattttctttatccagtctaccattgatgggcgtttaggtggattccatgtatttgctattgtgaatagggctgcagaatacatatgtatgcatatatctttatataattatttatattcctttggggatatactccataatgagactgctgggttgattgataattctgttttaagttcttttaggaatcatcacactgctttccacaatggctgaacaaatttacattcaactgggggagatttttaccaccaggaaatgtttgtctatggctggagacatttgttgtcacaactatggactgctacctgcatttagtgggtagagtccagggatgttgctatatatcttacaatgcacagaacagcccctcccacagcaaagaattctcctgctcaaaatgtccatagtgccaaggttaaatcttgatattataacctaaggttcccatcccaacttgaccaattaatcattttataactttctccgttctcctatttaacctactgggctttaaagccagtggccctttttcttagcttcctcattcatgaaacagttttctggggaggccctagaattttacctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggaaagagacccactccagttagttcaagagaaactgtttattgtaaggacacatgcagattgctaccagaagccttcatattctctccccactcccctgccccatggtcccctatttccactcccctccagtcatccccacactgtcctcctcccacagctgtcccctgatccttcctaacttcagctcattgtggcatcttttcagcccctgtatccacgatgctaactgaaaaatcctattctatttctaattcaaaagcccacatttaagctcatcctttcaaacccagccacagacgtcaaatttcagactgaggactggatatactttcatcggtccaacactcttggtcaaagcagcaatccacagcaagaagggtggggcaaccacaaagattggcatctctgctacactgtatcacacacactcctacccctgactccgagtgacatcaaccacagacagttacattgagctacaggaaggattaaaccacttccaagacccaggaggtcccctaatcattttgccccatgtcttggctcacacccctggaaacactgggggaaagtcacctaccttgtttggggacacctttttagaggataactcttggtcctcaagcttagaagctgttatgaggaagacgttggggcttttcagaataacatccgaagattaccccacagataccttctcctctggaatcgctctcaacagtgtcaggcagagccccgggagcccacacatctttctctgtgttcttgtgaccatggaaatcaggcaggtctcaagaaacaaagtcacaaaggcatgagctcatcatctattttcataacactaatgcaagagacctccaacacaagcaaagcaaaggcaccgactgggtgcagccacatatcatgagtttccaggccattctgcctgagttgagatcattatgctgcttctttcattgcacaggaacgtgggggttttctctaaactatgactcatagcaaagcatacaggcaatcatgtagagaaacctgttctccccaggaaaggagggtgagcaaatgctaaaagttttgatactttaatatagcactggccttggctaattttacttaatatgaaagatttcaaataatggaaacactgacaggcaaaaacattaaaagtttgcataaaatctcaaaaaaccctgcaaacaagagagaagcatggtctaattaaaataaaggaaaagattgctactgggttcctgaatactcttttcacaaaggcttcacgtcagatgaacttcaagcaccaagcagcagggatcccactgaagtttattcagcgcccttctgggcactaccagctgtgaaactggtaacctattgacaaataggttatttttccagctgcacccatattcaagagcttgaccagcaaagtcccctgataatatttggccatgagtcagaatgtattaggcaccttctgtagccagagccaaaaaaactctggctacaggagaaacctggcactgtgcacaagatccccttttttagcatcagctgtcccctttgcagtttgttaaagctggaggagttttaatccaagtgaactctctttcaggaggcttcggggtaaggaagctacaaaagcggggaggtaggggcacggctgcaaagtgatgaacattgcagcaggttcggctattcagaatgagctattttctcccaaatcctgtaattgcctggagcacgtgatctttttgaaggtcattagaggcatgcggctgtcagatctctcccagaaagtttcgctttgattagttagttcctgatgcttatttcctaaaaggctctttttgtcccccacccccccaaaaaatggggagcattaaaattttaaaaaaggaattagatgaatatcctgctaaatgtaacttggcaagatgaaaggaagtagcaaagaaacatgaaaagggtgcagaccttcttgggccccctgctggagagccaacctgagggaaattgacgcacgatcagcatattccttccccaaaatgaggcgactcggaaatacacaatatcaatcatcatctatgcaaccactcattattttgactcaaacagaacgacatacatcattggtaaagcccacgtggacatttccaggtccctggggcatttataagctgggaaaggttaaaaaataaaataaaattctcttttttaaggattccgatgtctaagaaagcagccatgaggacctaataaagaactagagctgaataagttgtccagtgactatgatcaaatatacagctagcaatggcaatgtttcacatcaaagaagaaaatcaaagttttttcccagcacagggagatggggccgatctctcttggatcaaaagtcctttttgtcctctcacatttgcagatgtgtaaattccaggcagatctaatgaaggagttaccttttcaatccctagattgtgtttgccaaaacttcccttgcaatagggacactccagcaaccctggctcggggctccctgcgtacttagatgtaatactatgtcaacaacatcctgcaggctgaagcagcctcttttttttaaagccttggatcaactatgcaagctcaacttgcttttatttttgttgaaaatactaaattcatttgtcatcactaattccctcaagcaaaggaacagctcctcgttgatgccatagtttgcaagatactgaagtcgcacgttgtttctaagaacactgatgctctaaatctccagcttttgacttcaggaaaatggcacttactttatattcatagaatttctggggcagttcttctcaaactttaacatgcacgtgaatcgccgagggatcttgttaagaggcagattctagctcggtcagtctggatgggacctgagattctgcattcaggttcccagaggatgtcaaagctgctggtgcatggaccacactttgaatgatgagatctgtttagctggttggtaggtacctggtggctgagctttcaaactctgtaatcagactacctgggtttgcatccagcctccactgtttaccctttcttactgtgtgcctcagcttccacatttgcagaatagtgctcaaaataacagtacaaatagagctgctccgtgggttacagaaagctatatgtataaatcactcggcacagtgtatggcacatgagcactcaagaggtgagctgtttctgccctggtgtaatcatccctcacagagcccttgttcccaccttctttccaggcagtagaaagccagaatagtctccagagacagatgaagtgaaattgcaagcttctgactctcacaactcaacccatcagcttaggttgttaaaaaagcgaggtattgcagtgcactatattgtcatagtctgagaagggccgtgtgcgtgcccttgtgtgttccaaaacctaggccacgatgtatagggaaaaaagagcacaggtcaggtggcccagggagcaaactgacctgtgagatccttcgtttgcttacttacaacattgggataataaaacctaccatgtagggatactatgaagatcagggatcatgtatgcaaagtgcctgccctgtatgcagtagatgctcaataactggaggctgttatgcttgtaatcaaaatcctatcctcccaagagcaaacaggagaagaagccaacataactggcaacttagccttgataactctttgtttatccgggcaagcggaaaagggcaggattccttggtgcttgggtagagagcttttccatagcctcagatacagacaggggcactgaaattatggggtacaagaggtttttccaggtggtccaggtgagacggagctgggagatggcagggaaagatacagtcacaattgataactagagagctatccattcattcattcattcatgatatttataagttggcccgtgtgtcaggtgttgtacaagacagagcagaggccccactctcaaggagcaaccatttcacagaagagacagaaacatgtaaatgaacacatacaagttaaagttgtggtacagctaatgacatgagggctcctatggaaaaggttagcaggactgtcacgaagccctctcaaaggaaatgccccaaaagccaagttgtgaagaagtcatcgtcaaccagtgcagaatagtgggaagagcattccaggcatagggaaccatgaggacaaagcccctagggttggaaagaacaaggaggaaaatgacagcaaacaaagccccaaaaaagcacgtagtgcccaaatcatgcagggtctcttcataggccatggtgaggatgttggattttattccaaaggctacaagatgccatgaaagggttttaaatctgtcttacaaaaccataaatttcacactgcagcaatcaagtcccacaatgtcctgaaactatggagtcagaacttgacctcttgacgccttctacttcttactagagattcaaggtctttgaccctggtgacacaacaccagtacgggattttttcaaactttttgcatttattgtcgaagaagcaggggcagcaaagaatatttggctttccctggaagtcccaagggatgctggacagaacaaccccaagtggaaagacccttgttaggagaagtcgagtaaatacactagtgagtagaccattcctccactacaagctcagcactcccaaggaataagtaaatccctacttaaattgcctgggaggcctccctcaattacacaaatctaagacatgacagggtacagcagagattctcctacagcaagtctgaaggctgagagcaaagcaatggagctaaggcatcatcctcatactgctcatggtgggaggaaaaaaaaaaaaaaaaagactgttccgagtctcccctccctggctgttttgctaagccccaggcctacaggaggctggatggcccaggggaagaggctgccttgcctaccctgggaaagtggatggagggtagcttcttcctctgccaagaaaatcaggcgtcctacagggagagagagctgggggtaaaggctgggtgggaggatgcttaagggccagtctttccccaaactcagctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatatatttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagccagtttcattaccgtatttcaaatattttgcagtattggcagggtttactattttcttgggcatctattagccattgagtttttattctctaatcacatgttactcatttctcttccatttttcttttagggtgttttgtctttttcttaatttgtaagtcatctttgtgcgttaaagatagtaaccctttggcacgtatcaccaacgtttttccctaccatttgttggtttctgttaattttctttatgttattgctggaactccctgaaacgaccacaaagcaaccatttgattctgccaaaaatattgtctttgaaatatggtttctagaacgtctgtgagtcacctgctcacatgtccaagatgtctcagaaatccttctgcttttataaaccttgtcttttggcctacagcaccagtctacactttttaccagctctgaggaccttctgagtcacactctgaagtcctgacctcaccataaacaaagagccttttctgggggagttggagctgccctaagccagtgaaagccaatgctcacacgcttgccctatccaactgctttcattagctccattctttttagtctaaaagccttcctgacagcaacaggggccaagaatttctctcatgaaccccattttcttgatttcaaaatccacttgccttgggagaaacgcttgaacctgggaggtagagattgcagtgagcagagatcgtgccactccactccagcctggcaacagagattcagtcttgaaaaaaaaaaaaatccacctgccttggtacaagatgggaaagtctttgggtgtttattggctgtatgttcaagatgaatcacctgtgagctgtggcatccatgaaaatgtggagctccttaccatcctcaagaactttctcaccactcaacctctgcatgtgatattcctccacctaaacactacctccctacccccatactccaccctggttggccaacttctaatcatttttccaatcttagcctaactaccaccgccctgggaggtcttcaccagcaactgtgccaggcacccttgtgcaccaagagcctttagtatcatttctagcatcatggtatatttatatataagaataattgcctgtttatctgtctccccagcctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccattgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttgcagctacacacttaaggacattctgatggaaggagctgtaatattaacctatctgggaagtgtgaactgtaaagaagaggccattacagaatgttgagattggccaaaccaccactgtagatgctccattcactggaaccagccttggaatgcagagggctcctgccaccccactcttctaggctagaggtgggcagcaccctccaggcaagagcatgaatcatgtgtgcctgcttgctgctccccctctctccaacagatgactgggcaaaaatagaagagaatccctcctttataaatatctttacatgctaaatgtctctataaagcaccatgcgccaagctaggctgctaagaaacagatgcaaaacagatgcaaagatccatgagatagctgagaagttaaagaattttaattcaacaaaaggcaagaaaagtttcttaggagcataatacagtcaagggaggcctgatgcaactggagagtcatagaaattctggctcccagctattaacaatagtatttcttaccatggcagtttcaatgcacatatgtgcacgagtgtgtctgtgcatacctgagcacgctcttatttcatccccgtaaccaatctttattcatttaacagatatttattaagcacctactatgtgcatcacttttttttttaagcacctactacgtgcgtgacttacttttttaaaacagggtctcgctctgttgcccaggctggaatgcagtggcacgatcagagctcactgcagcctcaaatttctgggctcaagtgatcgtcctacctcagcttcctatgtagctgggactgcaggtgtaagccatgacacctggtgaagtcattttagtttttagtagagacaaagtctctctgtgttgcccaggctggtgataactctcttaagatatagaaatgactaatgtccctgctttcaaaggacacatgctttaatgggaggagtttgattaaaaaaaaaacaaaacactaaccatataatacttagatagagctaagctataggagaaaatgaagctgagtaatgggctaatggctagagtggaggctacttgaacttggatgatcatgaacagcctgtcacagtcagcaatgtttgagacgaaacttgaatggtgagaacaagacaaccacagaaaggtccaggggaagaaattcccaagcaaacggaacaacaagtgcaaaggtgagtgtgaggaatgttccagaaagataaaggaccaagggaaaagagagcaggatttggtctgagatataagcaggagattatggtgctccttctaggccacagcaagcaattgattttaattctaggtaaaatggaaagctggaggaagattttaataaagatgcatgtgattcaagatatgggttttgtcatcgttcttactcactcgaccagcgaggtcatgcattgatcataggatgtcaaagctggaagaagataccagtttagaagatgctgctgtcactgaatgcagatttcataaggagttgcagtgaaggtagaagcatgtttcatggatctgtgttaagggcagagctagaagcccttgctgatggtttctacatagcaggtaagagggagagagaaatcaaaggtgacttgtaggtttgtagtttgaacagctagatggaaaatgaggtcatttactaagacaagaaagtaagaaggagagataggtatggggacatgctaaagacaatgagactcagaaaagccaagagactcattcaaggttacatggctgggaaatgatagaggcagacttggaacgctggtccctgggactccacggcagggttcaaatggtaaagcaagctgaatttccaggccaggttcagggaaacattgaggggaaaatcaaatcagtaatccaggcaaattcagggcataccacgtggctgatctattttcagcatccactcttgtgaaggctacttgtagaatcttagaattaatagaattttcgagctgagcagatctttgggctcaaaagggcatctgtgcctttgcaaacatgattcaccgaacatcccctgagtaggcagatgggtcaggctgctgagtagactttaaatggagctccggacacagacccatcttccaagccatcctattcactttctccccactgtcaaaaggaacaggacattatataaaccttctgaaatgccaaaaggaggaattctatatttaactcccctcccagcatccaaacatcacatgatggaatgttgaggatctaattcaacaatgttgagtaacagggatataacccaggggactctctctctccttctcgcttctcctgcaacttctcgtctccagccacccactgtcatgtcttcattaagggagttcgggagcagcctgactcaagcaggtccccaggaaagtaaacagctgggggagtaaaatggattgtgctaacatataatccatagctgccagggagctggaactcagagccaaacacagactcatctcttcagctatcctgagaagtgtggggactgaggactaagagggacagaggcagcaatataaaaaccagtgccctcaaggttcaggaggcaaatgaaatggaacttaagcttctgcatctctgcagtcgggacttttgttagaaaagcacttaaaaaattcaaggcacatccacaagatttcaagagctggcatgatggaaaatagcggcaggggctgatcaagatggcatggagtgaggcttctgaaaacacttattgaccagcttgcatgctgtgggtgatcgataaatattaaacaccgaggctagtggagaacaggttttaatgaggcccagaacagcatgtagagtgggctgtagtagtgaggggccatggagatgctaagcaaccagtctcatgcctgcaggtcccccatgtccatgcttctccctaggctgttctcagttacaaagacaaagcaaaccaactcggggggaaattcatcgggaagttggaagctaaagggtccctcctagcatggccaaggcctgccgctccagtctcttctcaccacttatcccattttttttttttttaatgctcagggtataacaataaataagagagggacagagagcacctctgctctcggagtttccaggctactgagagaggcttcaaatgcattgacaagactagagtaggaaagtaccttctgtgataggccctcagagaaagggcgtctgtttcagccaagaaggtcagggaagacttcctgggagacatggcttttgaatgggattagccagtttaagaggtggggaagaacatttcataggcaatggcctgagtgcctgctgttctttttgcttgtaacacacttgtgcccctgacccaccatggatcttgtattctcttcactaatatccctctgcctagagtggcaaaacaggaagagtaattcgccattattattagcatgttattattgttattattactactactgttattattttacttatgagcgcttatgatgtgtcaggcactgcactaagcattttaccaccattattctcctctaagctccatatccctaaaaaaaagtattataatccccatttataagtaaggaaactgaggttcagagatgtgaaatagtctgggcttggtggctcgcgcctgtaatcccagcactttgggagactcaggcaggcagatcacttgaagtcaggaattcaaggccagcctggccaacatagtgaaatcccatctcttctaaaaatacaaaaattagccgggcgtggtggtgcatgcctgtaatcctagctactcaggaacctgaggcaggagaatcgcttgaacccgggaggcagaggttgcagcgagctgagattgtgccactgcactccagcctgggcaacagaatgagcagaacaagacaccgtctcaaaaaaaaaaaaaaaaaagatgtgaaataacttgtccaaagtaaactcagccagtaatgggtggcaaagctggatttggggccatgcaacatgtctccagtgcacctaaacaggtgctataccacttaccactaggtcatcctacgtcaaatgtaaagccacacattgagctatgtcgtgatggctttctgacctaactcctcatgtcccttgacatttatcatgcaagagctagtccataggcattggaatcattcgggcatggggttaaatcccagagccaccactaactagatctgtcattttaagcaagctatctgaactttcattgcctcggtttccacaaccacaaaatgggaatttagtacgtatgtcctaaaggactgcagaaagaagcaaaataatacgtctaagcagtgtagcagaagacctggcacttaacagattataagtttcccattgctgctgtaacaaattgccataaagttagtggcttagagtgatgtaaaatgtattaaagtcctggaggtcagaaacctaaaatggaccagcaggccttcctagtgcttccttctaaggctttagaggagaatccatttcttaccttttccagtttgtagagtctgcccacattccttagctcatggccacatcactctaactctgtttccatggtcacatctccttctctgactcttccatgcccgcctcttataagtacagtcacaattatattgggcccaccagataattttggatgaggctctcatctcaagatggatccataacttaatcacatcttcaaaatcccttttgccataaatcataacatttatacaggagtcagagtttagaaggtgaacatctttgagaggtcgtagttctgcctgccaggccaccatcttgctccgaaagattcactccatctccccaaaactaactcacgatagtgtcaaagtccaaaattttcatcaaaatctcatcagaccaggcacagtgactcatgcctgtaatcccagcattttgggaggccaaggcgggtggatcacctgaggtcaggagttcgagaccagcctggccaacatgatgaaaccagtctctactaaaaatacaaaaattagccaggcacggtgctgtgcacccataatcccagctactctgaaggctgaggcacgagaagcgcttgaacccgggaggtggaggttgcagtgagccaatatcatgccactgcactccagcctgggttgacagagtgagattcagtctcaaaaaaaataataattataaataaataaataaatctcatgagctcagatgtctaaaatcttatctcaatcacctaagtcaagtacttataagaatctgagcatgatccctcctgggtcaaagtttctctccaactgtggacctgtaaaactagaaaacggattatctgctccccagatgcaattgtggaacaggcatgggatatcagttacaggggtttttgattaaaaaaggaatcaatgaaaagaaaaaacaagttaccacatccaaacaattttggaattcagttaggcagtccggatgcagtggctaatccctgtaatcctaacactatgggaggccaaggtggttggaatgcttgagcccagacattggagaccaacctggacaacgtggtgaaaccccacctctgaaaaagaaaaaaaaaatacaaaaacagattagctgggtatggtggtgcatgcctgtagtccaacctactcaggaggctgaggtgggagaatcacttgagaccaggaagtcgaaggtgcagtgagtgatcacatcaccacactccagtctggccttcagggtgagacactgtttccagaaaaaaaaaaaaaaaaaaaaaatggagaggagagattcagttaggcaaacattaggcttcaaagcctagaaataatcctctcccatctctgtcctttgagcttgaggctctaccctctgagtaaccagtcctttctcatgaagggtaatatgtgtttccagcctaagagttttaaccgtcatttcctgcctgtagaatttggggagtatatcataggtgataattgaacaatgagaacacttggacagaaggcggggaatatcacacaccggggcctgtcagggggtagggggctgggggagggatagcattaggagaaatacttaatgtaaatgatgagttgatgggtgcagcaaaccaacaggggacatgtatacctatgtaacaaacctgcacattgtgcacatgtaccctagaacttcgagtataataataataaaaaaaaaatttagggagtgtaatggccttccttcattttatcttctctgttcccttctgtccaaattgccaatgtttatgctggtaggaaatttcaaaaaccttatgggtctcctgagtatgtcatggggattcactccatcagacaaaaaatggttcttcacagttctttcctagataatcctaatatctattctttgcttctgatttgatggccaaggggtacatgagtctcatacctaatctcttcaaagagcactctgtgtggctgaatactgggactttttatctttccaacgaactagcaaaaaaaaactgttcagccataccctttcctaacatgctttcctgatagtaaatctcctaattttagcatcttttgcaatccagataggctgagaatttcccaagtcatcaaatcttgctttctttttgcttaacagttcttgcttcaatctctttcctctcacattttactaaaaggagcaagaagaaaccaggctgccccttcaacactttaccaagttcattgcttgcaagttcagatttccacacaactgtagcatataattcagataaatgctctgccactatataacaaggatgtcctttcctccagttttcaataacatttccttcgtaggtagccctccctggtaatgcttttaacgtccatatttccaccaaaagtctgttcatgatgatttaggtagtctctaaaatgatgtatgccttctctaacatgtttcttacttctgagtccccagaaacagaactgttagcattcgtatttccactcacagtctgttgaaggatgtctagtctttttctctgatgtgtctccaaattattctagcctctgcccaacacacaattccaaggccactgccactttttaaggtatttgttacaacagagccctattcttggcaccaaaatctgtattattgagggttcaattaaaggaacagatgagcgggagacatatattaagaaatacatgacaaggaattggcttacatgattgtggggaatgggtaggtaagtccaatatccacagggcaggctggaacttctgggcatgagctaaaccttctctcctcaggtggaatttactcttcagagaagcctcagctctactcttaaggcatctgactgattgaatcaggcccacccagattatctaagataacctcccttaaagtcaactgattataagctttaatcacacctacaaaacaccttcacaacccacctacattagagtttgactgagtacagactgtagccccatccaagttgacacagaactgacagttgttgcattcatcatactccgtccctaacactcaagacagcttctcacgcattcctctatctcctcccctggggccaaggtccagataagcacatgtaagttaagtgagcaagtctaaaagcagatgtgcttatcctttcaatcactctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaaaaacttcaaggaggagattcatttgcaactaggtgctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctgtcagtggaaatgtcttgaaagaataagttcactccaccttcacaaggatggtaatgatgatgatgtttatagcagctaccatttatgggggaactgaccttgggcctcacgactgtgctaagcacttaacatacaatgtttcgttttatcattattatgacctgaggccctgaaaaagaatttgagctcccagtggtttgagaaatgatcccaggaaacactggtaagaggaaagagaagtgagacagggaagtaaaaggaaacaataaatggtaaattttaaattaagtgactgcttaaggcaactgggccttaagatcactagagacatctgggatatagcatgaaatatctactctacatcacagttatcctgcctacaagacaacggactggagtgcttatccacaaatccctaccgttggctgcttccagcaccttcactccccctgcaggtgggctaaacctgcttccaaagccagaaaagacagagtcggaggggttcacagtgagcaagcttcagtatatggaggcaaggactgggggcatatgggaaagccccaacagcacatgctacataaccctaataagtaggtggtaccaccctcatttaaaaggagaacaaaaatgaggctcagagaagataaagtaacttgcttaaatgaggaggctggattgaaagcaggcctgactctaaagtcacattcttgccccctacacatgctgacaggtgttcctattttctccatcttagtttgagccatatcacccacacctggaggtctgcaatgacctaatgctttcacctgcctccagtccttcctgcacactatggacaatttcatttcccttccttagctacttacaaaacggaggacgaagttcaaactccatattcaggcactcgattattcccgtcagctggctgtatggccactgtatgccttcctgccccagccctggcctacatttccttaattcaactcacgtgccatttttcttcttttcaataaaaattcactgtgcacctattctgtgtgagacactatagtttcctcctctgtaaaatgggggtaattgtagggttaagagcattaaatgagagagtgtgacatgcttagcacaaagtaagggctgaagcaatgcaagcccgcattatgagctcacccaagagtcatgactttatcctcagagcctgggatgcaccacatagtacttgtcataaactcctagatactgaacatgatctctctgcctctgaggggccagctccttgagataatgggctgtacagtctgggatgacagaaagaaccttgggcttatagccagaagccagattccaaatttggattttaccaatccctggccatgagactctgaccatatgaatccactcctagaccctagttctgtcatcaccaaggtgggcatggcactttcctcttggcattagtagaaattaaaggctctgtagataatgcttcatgaaaagtgggctgtttccatcaagcctaaatcatataagtgtgtgagatggttaacactgaagactcagaagtcagagagggctgagtttgaaaccacattcgatcactattcaactgtgagactgtattggttcattttcacaatgtaaagaactatctgagactgggtaatttataaggaacagaggtttaattgactcaccgcttggcatggctggggaaggagacctcaggaaacttacaatcatggtggaagacgaagaggaagcgaggaacatctcacacagcggaaggatggggatgggtagaaaagaagcaattgacacacacttttaaaccatcagatctcgtgagaactcgcttactatcacgagaacagcaaggggaaaatccgcccccgttatccaatcacctcccaccaggcccctccctgacacgtggggattacaatttgagatgagatttgggtggggacgcagagccaaaccatatcagagacactgtgcactctgtttccttctatgagcctcagttttcccatctgtcaagcaggggtaagaatagtgccagcatcccagacttactgtgaggattaaatgagatatttaaagtacctggcatagtttcttgcacataataaaatttcaatacatgccaactattatcattatcattattactatgccatcattatcagaatgttttgaatatagaattgcttgaggatagtttattgaatgatgagtgaattaagtgctgagagaacatcatccactaaggtctgagtacctagatttcagaattcttggtatgggagttctccagtggggaaacaaaaagccttgcaattaagaaaactgaaaaagaacagaacaggcttggcccagttgccgaagaccagtcgtgtgtgaaatgcctcagaacaccggatggagacagcacggatcaagccaagtaaaaattgagagcatgaaacagacagccctggaggcctggaatctgctgaggccatttcttcctgagacctaggggtggaagcttgggggtcaagtctgctttgagaggcaagatctcaggctgtgtgcagaacacttttgcacctcgtgtctcagtgatgggaggtcagggtgagcttccccaccaaaccccaacaggtgtttattataccctgtggggaggcagggagaggagagggaaatgtctcttctgaagaggcctagggcaagaggggcagctgaaagcctcattacaatgaaaacagaaaatagatcaaattaaaagccaattaaaaacaaaagccaatctgcttccattgttaaaatccagattccagttgtctgtctgtagggtttggcctgtgcaatttaaacaagacatcccaggggatacagatgtggctgctcacacttagagtagtaaggccttggatgttacttagtccagtgtttccagactttctttacgataagaatcacctggggataccttgttaaaaaggcaagtatgcaaccttacccaaacatactgaatcaaagtggggtggggggaatacccaagaggttgtaagtttaaagagctcacaggttatttttaatatcagagaggtttaggaaacactgatttggtctgtatcaggtgcagcaaattcaaatatgtgcagaacccagagagatgagataaataatttttttttttgaagggagtctcactctatcccccaggctggagcacagtggcgcaatcttggctccctgcaacctccgcctcccaggttaaagtgatcctcatgcctcagtctccagagtagctgggattacaggcacctgagatccagtaaatgagaaataggaatctatagccctgctgaacatttcataaggcctggcataattcaaattctgccctgtaatcaggctgtcccaggcaacacaggcaagattaaagaaatatttaagtttatttgctttgggctggaatatatataactcagtgtagttccactggttaccttatgttctgttgatctgcatttctaagtggcaattgattgtatgctgttaattcatttttttaaataaaatcgattagtacttaattaatgtattttgttttgccggcaaaacacacagtataccatgacgataaaaagccgcaggataagaagagtccctggtgaagaaaaggtgaggaacttcagaagaattcaggcccaaatctctttcaaagatttggaaactgggttcccaaaaagagagttgacacatccagggtcggagtgatagtgacacagtcaagactagaatccaagtcttccctgactctcaatctagtaaatttttctattataattcaaataggtagcctatgggagaatgagatctttggttttctctagtccagaaaacactctttcttctggcacttttggggaaccaactgtccccacttttcattccatgtagctcaagtggggcaacttcagcatctccagctctcaggatatgcacatgaccagcctggtcagtcagtgtattcctatcctgaacaatgtgattggttgatttatgggcaagtgaggaagaggagtccaatcagagttagccctgggacttctgatgaagcgaccaggaagtggactctgcactctgtttcccctaagtcacttaactgacagaataaagatgcaacacttctgctagtgactgtcttgccacactgggagttggggtggggagacattccctgaataaagtcaatacaggctgggtgtggtggctcctgcctgtaatcccagaaattttggaggccaaggtgggaggactgcttgagcccaggagtttgagaccagcctgggcaacatagtgagaccccatctcttcaaaaataaaaataagcaaccaggcatggtggtatgcacctgtagtccaagctactcaggaggctgaggtgggaggatcgcttgaaccccggagggtgaggctggagtgagccagatcgtgccactgcactccatcttaggagacagagcaagacactgtctcaaaaaaataaaaaataggccaggcacagtggctcactcctgtaatcccagcactttgggaggataaggtgggcggatcatgaggtcaggagttcgagaccaacgtggcaaatatggtgaaaccctgtctctaataaaaatacaaaaatagccaggcatggtggtatgtgcctgtagtcccagctactcaggaggctaaggcaaaagtattgcttgagcccgggaggcagaggttgcagtgagccgagatcatgccgctgcactccagcctgggcaacagagcgagactccatctaaaaaaatgaaataaaataaaataaaaacacaatgaatacagagaagaatcaaggggaaaagcaggagagaccaaatccaaatgacacctggatctagccaggctggaagattcctgctcttttcagttacatcacccaccttgtctgacttcctacagctgccattggttaaaaacaaccataatgccagaccttttcatatatttctgttgtaaaaattgagattttacagatgatgttcatttacactatggcatgccatcctcagggcacctctgtgaggtaaataggccaagggctattttccacattttacaaatgagataccagagctcagaagggaatgatgcattgccaaaggtcacactgctcaccaacagcaggacagggacaataaatctggtcttatgactccagctgagagtgctttccaccacagcactatgtctaacctggtggaaatgcagcaacttcaatcctcacctgcctcaacttaggagaagcctctgcctctcctatcacactcaacagggatatgtttcttgaggctgatgccagctcaaagcttcattgcaaaattcttccaggctacctgttctgagttataggaaatatcccaaagcgcccatgtcctaccattccagggtacaaaagagcacgaacccacaagaagatattggaagatttactgagccacagggaaatgaggaaatgagagcaaagtaaggaagttatataagggtcacacacacacacactcaaaaaacccagggttaaggttagctgcagcacacagagacttgcagcttacatttagggagacgaataagtttaaagaacagataaattaaaaagactaaggctccatacacgtcagagccctgacttaacctcaaccatccaggctcaagttaaaccaacgaaagtgaccaggcatagtggctcatgcctgtaatcccaacactttgggaggtcaaggcaggaggatcaaggccacaagttcaagaccagcctgggcaacacagcaagaccctgtctctacaaaacatttaaaaattacccgggcatggtggtgtgcggtggtgagtatagtctctgctactcaggaggctgaagagggaagattgcttgagcccaggagttcaaggctgcagtgagctgagatcatgccactgtactctagtatgggcaatagagcaagactctgtctctaaaaacacaaacaaatttaaaccaaccaaagacaccctaaccctctcccatttccacctagcttctctcaagtccctgtctctgaatcagaccctcttgctatgatctctctcagtcacattcccatgtaaaattctcgggtctcatcccttttccaattaggtatttaatacaactctgatcctggtgccaccacataataatttacacagaacacttaattagcttcttagataaaaataacatgtaatttgtttggtaattatatgtttccacaactgctgaaagcaactcattataggaatttggtatacttaggatagattaccttaattctattttctgtttatccaattagatttgccggtcttaattgtactataaattgtgttgagctggtgaagatgactatgaagttgttgttccttcagatttcatggttggtatgcatgtcgctggtgtttgctccaggcactgactaactctgtctgggttgtgaaaacaaggacactgtaagacctttcatacctttcaaagaagaaagtggacaacgccttccgctaagggcctccttaacgtggtgtattccagtgtgtggtatactgatggtgtacaagatcattttagatggtgcagggatacattttcctcttaaattttcaaaaattcaggagccattctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaataataaaattgtatttatagtcaatacaggagttcttttaatatacttactgaaactttaaattaaaatgatataagttctgagatttgcattaaaataatcagggggttggtaaggtattagggaggagggagtattaagaaaacaagattgggcagggtgcgatggctcatgcctttaatctcagcattttgggagaccaaggcaagtggatctcttgagcccaggagtttgagaccagcctgggcaaaatggtgaaaccccatctctactaaaaaacacaaaaatgagccaggcatggtggcacacacctgtagtaccaactactagggaggctgaggcaggaggattgcttgagctcaggagatggaggttacagtgagccactatcacgccactgtattccagcctgggcaacagagtgagactctgtctcaaaaaaaaattttttttttaaataagattgtccccaacatggctctcttggataatgccataatgaacatgagtgaacatgagggtacagatatttctttgagatcctgatttcaattctttgggatatgtacccagaagtgggattgctggatcataagatagttccattacgctggtgctattacttttaattgcaaaaaccacaattacttttgcaccaaccgataataaaaatttaaaaatttttcgaggagccgccatactgtttttcatatcagctgcattattttacattagcaccaacagtgtacaagggttccaatgtccccacatccttgccaacacttgttatctttggtcatttttataatagccatcctaacaggtgtgagataatttcacagtcactcgttgtggttttgtgttgcatctccctgatgattaatgatgttgagaacctttttaatgcctgttggccatttgcatgtcttctttgaagaatcatatatttcaagtcctttgtccattttttaattgtccatttaataattttcactactgagtcataggaatttcttatatattttggatattagccccttatcagatatataatttgcaaatattttctcccattctataggataccttttcattctgttgattgtttcctttgcttcgcagaagtttcattgcagcattattcagaacagccaagatacggaaataacctaaatgtccatcaagagatgaatggagcctggccaacatggtgaaacctggtctctactaaaagtgcaaaaatgagccaggtgtggtggcacacccctgtaatcccaactactcaggaggctgaggtgggagaattgcttgtacccaggaggcggagactgcagtgagctgagatcgtgccactgtactccagcctgggcgacagagcaagaccctgtctcaaaaaaaaaaaaaaaaaaaagagagatgaatgaataaagaaaatgtgacatatttatacaatggaaaattgttcaacctaaaaaaaaaaagaaaaaaaagtccgctatttgcagtaacatggaaaaacctggaccattctgctatgtgaaataagaccattacagaggacaaaaactgcatgattccacccatacaggatatctaaaatagactcatagaagcagagaatagaatggtggttgccaagggttgggggcatagggaaatggggagctgctgttcaataaagttttagttatgcaggatgaataagttctggagatctgctggacaacatagtgtctatagttaacaaactgtattctgcccttaaaatgttcttaagagagatctcatctcaggtgttctcactacaacaacaacaaaaacaaaacaaagagacacaaggaaactgttgaagtgaaagatatatctattaccttgattgtggccatggtttcacaggcacatgcatacatccaaactcatcaaattatgtatattaaacacacgcagtttttaatattatttagatgtcaatgcagctgtttttaaaaaaaaaaaattgaccatgagttgaagctgaattgagggtacatgagtgttcattacacattctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttctaataaaactttatttacaaagacaggtggcaggccatagtttatagatccgtaaagtaggtgataccttgatatggcaaaatccaggaaggtgatacaggaaagactgaaataagaacagcattcagttactgggaccctgagtctcctctctttagagaaattaataaattcttatgaattcagtcttactcagagacagctataggacacccttggtgccaggtagaaacacaaataaaaggaagacaggaacaagatgggagcacggatgcatatccactcatccatttattcaacattttttttttgagatggagtctcgctctgtcgcccagactggagtgcagtggtgcgatctcggctcactgcaacctccacctcccgggttcaagcaattctcctgcctcagcctcctgagtagctgggattacaggcgtgtgctaccacgcccgactaatttttatatttttagcagacacagggttttaccatgttggccaggctggtctcaaactcctgacctcaggtgatccgcccacctcggcctcccacagtgcatgagccaccacgcccagcccattcaacaacattttatagaatcccctaaaggtggaggtcatgtttgcatcagagggtggtacaaggggagggaggtacttagcctattcctcaccatcttcatctcccactgagatcacctcacatacaggtgcccttccactgtgcttagccagtgagggactaaagactcccccacagagtataaattgccatgtctatttcagagtgacagctattaatattattattgttatgactctgaaagcccactcatctttgagtctctggcaagaggtgaaagacaggtgttgggaggtggctcctggagcgtctgtagacagcatttgcctaaataatggaatccacgtgtaataatcatgcttgagataaagagcttccccatccctcatgtccacttgcttttggagaaactacataagcaacattcccaagcagatgaggaggcatgaagcaagagaccttgatagtccagaagccgcatgagaaacgtcagctaaatgtagccaccctcttgctactacctacacaatcctctccagtgcaattggaaatcctgaatctcagcaaagatcaggcatgctaaactcaaccctggagacctgccttgcttttccctcaggccacccaggtaccatgtgactttcttatgagatgatcaaaacagtactttgtaaaggaacacttctattcaccaactcactcagcaaaatacttatggcaccccctgtgtatgccaggcatagtattaaagaccagggagaacaagaagagtaaatctagtcccacactctaggagcttaacgagcagcaattttgccctccccccagcaaataattgtctggcccataacgtcacgttcaaagactgagaaaccctgctaaaagaagacacagattttaaagaaatgataatgtgaaagaattaattgtagaagtgtactgtaatcccagcactttgggaggccgaggtaagcagatcatttgagctcaggagttcgagaccaggcttgggcaacatggtgaaacaccgtctctactaaaaatacaaaaaaaaaaaaaaaaaaaaaaaatagccaggcatgcaggcatggtggtacacacctgtggccccagctactcaggagcctgaggtgggaggatctcttgagcctggtagggcagagcttgcagtgagctgagattgcaccgctgctctccagcctgggtaacacagtgaggccctgtctcaaaaaaaaaaaaaaaagaagaagaagaagaagtgtatacagggtccaaccatagcaaaatcatgaggaggatcaccccaaaatacaagcatagcttctaccttaaaaacagaaatgaaaacccttatgtgacctcgtgtccctctgtagataattctccatttctctctgttcccttttatagcaaaaatgatctagagagttggctataaccaccctgcctacttctgtgctattctttcctctacgaactctggtcaggtgtggccacgacggtgctactgaaaggtatcctgcaacctctgtgttgtcaaatccacaggacaattctcattccttgtcctaccagcatcagacataatggagaattcctttcctggacttgccttcctgagcttcccactgccctggttttcttgctaccctactggttgctccctgtcagcctccttgatggtttgtcatcaccttcccaacctctcaacattgtagagcccaggaattggcaaactacagcctgtgagccaaatccagtccaccacccagtttttgtacatagagtttcattataacccagccatgcccattcattgatgcattatctagagctccttttgtgctaaaacggcagagttgagtagttgcaacagatcctatggcctgcaaagcctaaaacattttctactggccatttgtagaaaagtatgacctaagttatcagttaatcatatttccttaaactgactccattttaaatgaattttttattacgaaaattaccaaatataaaagagtggagcattctgtgaccttaaatactatctaaatgccgacagctgcacccacaacccaggctctctcctgagctccgtgttcacagatctagccaacctgtttgatatctgcttccacttgaatgtgaaatgatttgctgacatggccagagcagagctagagatatctccctcttctctgcgtcttccccatctcaacaaatgtcaactccatccagcacgttaactataccatattaaaactctaactaaaaataaagctaacatatgacccagcaatcctactgctaggcacatatccaaaagaaaggaaatcagtatatcaaagagatatctgcactcctatgtttattgcagcactattcacaatagccaaaatttggaaacaacctaagtgtctaccaacagatgaataaagaaaatgtggtatatatacacaatggagtactaatcagccataaaaagaataagatcctgtcatttggaacaacatggatagaactggaagtcatgacgttaagtggaaaaagccagacacagatagacaaacttcacatgttctcacccatctgtgggagctaaaaatgaaaacagttgaacccacagacagagagagtagtgcaatggttaccagaggctggaaagggtattgggggtgtgagggcagggaatagggatggttaatgggttcaaaaaatagaaagaacgaataagatatggtatttgaatgcacaagagagtgactgtagttaataacaacttaattgtatatttttaagtaagtaaaagagtataattggattgtttgtcacacaaaggacaaatgcttgaggtgatggatatcacatttaccctgatatgattatagcacatttgcatgcctctgtcaaaatatcccatatacctaacaaatatatacacctactatgtatgcacaataattaacaattttaaaaatttaagaaagaaatctaggactttgcccagtggggcaacctgggtgaagcatatactgaaattctctgtactaattttgcaacttttctacaactctaaaattatcctcaaattttaaagttgattaaataaaagccctaagaatcattctttctctctcattcttttctttctgttactccgcacatcaaatccatcagcaagtacagagcagtccactttccaagcacatccccaaactggtcagtttcaccacctccaccagtacctcctcacccaagtaaccatcctgtcctgtctccacctggattattgtaatatcctcctaactggcctccctggtgccccctatcccctcctcactccagaactcctactatccatgcagcatccagagtagtattttttaaagacataaataaagttaggtcaatcctttgttcagacccctccagtggttttccatcacagttgaaataaaacccaaactgctcttttaaaaagtttaattgtgtttaattgaacaaagaatgattcaagaattgtacagatctcgaaccagaacaggtgtgaagaggctccatttctaccacaaagaaaatttatggacagagaaggaaagtggcagacagaaaatggaagcgaggtgcagaaacagctggatccattacagcttggcatttgccctacttgagcccagtttgaacagttggtcccccttgattggctgaaactcggttgtttggacaacagtgggttacagtctgtttacacatccagttaggttgcagttcactacttatggagaaacctttaaagtatgtaaagaggcagcttttcgctaaacttaataattcccccttttgatcaacctctcagttgagagactgaccaaaactttaggcactggcatcactctgtcactatttggtttcaaatcccactaggaaatagcagtgggttttataaggtgggaacaagggcttcaggttattttttataagggttagagtagaaggaaccttcttgacctggtatctcctgttttcaggagaaaaacaaaaccaggtctattttaagatctatttgtttttaaagtcttttcatggccaagtcccatgagagctgccctctctctacctctcagaacctgtttcctcccacttcctatctgatcactctcctgcagccatcctagtcttcttactattccccagacatggcaagcccaccctcccctacccacccagcgtctagacacttgcagtcacctgctgcctatactccacacggctcacttcctcacctcctcagagagacctttcctgctcagcctctcttaaatactccacctttatccatccacagcactctctgtcttacctctccctgctttatttccctgtctagtacttaacactacctaaaattaacttatatgcttcttcattctgtttatcatcttgcttctctgaaaggtaaacttcctgatggtagagatcatgtccatcttgtttatggctgcaacctgtgccctgaacatgcctgacacatggtagatactaatatatctgttgaatatcatgcatgttgaatgaccctacccagaagaagtcaaagaaagtttcccgaggagatgactgttgagctggggactaaacaatgatgaaacaggcatgtgttaatttctttggctgcatagcaaccactactgccatcaatgccctcggggaatgctcactcttcctgtccgccatcttgatgagtctattaaatgcacttgcttgatcgagagctgagatgcaacatgcaagctgtgtccaacaggctttttaattttgagtagcatgccctcagagtcctgcctagtcccctcaacctctcaagtttgtgagttccccctcttttccttttcaactttagctagccagagaatgtgtctggtgcttacaagtgaagaactgtttctgacattgccagttaggtggggaggtgcattctagacagaggtaacaacttgcaccaaggcattgaagcatgaagcgatgggaaacaatggggcatgaaaatcaaatgttccttcaaggtgcaaacatattaccctaaaactccatggttccctagggactcaattcaaaagttacagggccatttttaggacatctctttgctataggaaaacaggacattttctgcaagatcaatgcttgaccaacatcagattcaatttttgcatccttcaaatcatatcaggctggaaaattaaaagtttcctctcatttttatcataattactataacaaccactaccatcttgtgtttgtccagtaatttcagcttttcaaagaaatttcaaatccattaacttagtctctaccaaggcctccgagttcgaggcattaaaggctccccaagtggaattaccaacgtgttataaacgaaagaatctgagtcaccaaaacagcccagcctctgtctgacctccgaccctcctcatctgacactacagcttttcccaaggcagctgcaggtgagatattcattcaaaccagcaggaagagaaatgctgaatctgcacaatcagaaccttctgctgacttagcaccatgtctacagagatgctgctcttgtccttcgtcctgagaaggagacacagtgtgcctgaaggagcccatctcagacaccctgcccctggcagcagccaccagggaagccagtacaatagtggtctcagtaagggaggacctaggactgcgcaaaaaaatcaagcagtgtaacccaaaaatccagataccagacagatccaagaatgtggctagtgccatttccatttgctcaaaattagcatcaaagttaggaagagtcagggttaaaatacaaacaccccatgctccaaccaaagcgatctgcatatggctgtccatacgcaccatgtacttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgaaattctatacatccactgagtccagtccgttttccccccaaccatcactcactctgacctggttcattctccaggagcctcagctgatttttctctagcttgatcacccttcttggtttcatgttcagttcaccattgcctttaatgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcatatttctaagtgaaagaagccaatctgaaaaggttacatactgtatgattccaactatatgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccatgtaggcctatcagttgtaacaattaatattgttacaagttggtactattctggtggggtatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctacgaaggggatatgctcctgcccaggtggagtttagcagggaatctggacagtgatgaagtcatttcaaatatgataaacccatcaggtatacacaaggagaaaagctaattttcatttttataggtattttataaacatttttctaaacactctactatagttagggtgattttacatatttctgccttgtttcttgtgctagaacataagatcctggccttgagtcagaggacaagtcaaaataaattttgtagccagagctaagttcagtatactgactctaagtcctataattgagactccaataccaaacaatctttgtttgggctggttagaattttccactcttacaaatgaacactcacctcatctagacctgccacttggacaactgagacggaaagatctccttaatgcagcatgtcctggaattcaagatattcattcaacaaacactgcctggtcacctacttcatgtcaaaccccgtgctgaatgctggaggggcatcggggtcttcgcaagtgctgtttcctccaccctcctcccacgtattcacaaggctcccctcctttctgcattaaggtctctgtgcaaaagtcctcatgtcagagagggttcctgtgcattcattaatgctgtccaccccacagtccagttttcctctcgttccaggcacatggcaggagagccctttcctggccccttgaatcagttgtggcaatcaaatgtgagctgaagcccttaagagccagcgtatgactcaccacatccccctccccacctacaccacaacaaccagccatgctccatctgggcccacaagtgaggcgatatggcgcagaagtcgtagccaaccctcggtgggcacgttgcatgaacgagaaataagcctttattgttataagccattaagatacaggggctgtttgtgcagcagggcctcatccatcctagctgatccagctttcctgaaaccctatcttaaagggcatctcctgtcactttcagtctctttaccctgctttgcctgtggcacttaatgcaatctaacattatatatttaccgtgtttatattttgtccccatcccctggaatataagtttgataagggcagggacattgttcccccagcatcctcagtgccctgaactgtgtgcctgggtagaggaggctcagtacatgtttatggaatgactcactgaacacattaacacataagacactgttcctgtcctcactgaggacagctgggaagctaaatcaacaaataaattatcagaatgcaggagctacaaaagtataggaacggcacctaatcctgtgggggacagcagtccaaggtttctcagagggcatggcttctgagatgagttttgaaggatatgagacagacagaaatagcagcacagacaagtgccagaaaatgtgaaagaggcacatttagagcaatgtgggtttttgttatattttagcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaactgcaaaatgaggagagaactgagttgaagctcaaaaggtcagcaggggtcagaaatcagggatttgtgcagccaggagtttacattttatctgaaggcaatgcagtgcacatggtgagtttgcaggaagaagttttattaccatcccccatcacagaaaatgaatatccttgttggtcttttcatcagcaccagtaatcaacatctgatgggccaggagacccatgggactggtactcaggaagcagtgtgtccctcagcaagtccctgagcctctctgagcctcatatttcacatctgtatgatggttcaagttaaatagtggacatcccttctacagtccctgccaattctcctggcagataatgtgactgcaataccatccatgattataatgtttggtataacgatttaatgtactatcttttccactgaaagagctctgtattagtctgttctcacactgataataaagacatatcggagactggtaacttataagggaaagaggtttaatggactcacagttccacatggctggggaggcctcacaatcatggcagaaggcaaatgagaagcaaggtcacatcttacatggcaagagagcatgtgcaggggaactcccatttataaaaccatcagatcttgtgagacttattcactatcacgaaaacagcacgggaaagacctgcccccatgattcaattacctcccactgaatccctcccaggacacatgaggattatggaagctacaattcaaggtgagatttaggtggggacacagccaaaccatatcaagttcaaaggctcaaaggacttcaaaagaaggggcaagaataaataatcgcacagaaatccactttaagtggtaggagggaccctggacgatgaaaagggtgatctagcccagggtccaggaaaactgtcaggcttcctgcccatctgcccactctgcacctgcacgcatacctgacttctttctccctagaagagctcctgtcccccacagtgattttcaactctcttgctatgcatgaggtcagccatttcatggctccacccaaatcttctgatgcaaaagtggaatggactcatgccataatgctgggctgcctgatcatcgcatgtggtcagctgtgtagcagaatataaattttaaaaacccaaacgattaaactgtcacttcctattagacaaagcacattccaagatgcaactaatgagggaagagaaataaggaaagaaagtatgtttgacagaggcagtgtggctatagctttctccacttctgattgacgacaagatggtttctcctgcaagtaggcacagatttgctctttcaacccacgtatactgggcactgaggggaggaagatgaaaatggctacagcaagggtatagaagaggaataaattcacagtcatgtggggaggccattctgtctgtcttctggcataaaaaaagactgagtgcataggaggcagaaggcgattgcttcaagcctaagaaatggaaaaggcaccttggagaacttgacacttaaaacttaaaggacttaaaggcaaagcgggactaacaatgacatgtttcacacttgtatttcttcttacagttttcagggttttcatacaccttatttcattcgatcctaataagaaccctgagaggtagatttcaactgtgctttccaaaagtaaagatggaggtgggaggaagaactcagcgatggagctagaactatgggcacgtgaaagaaagaacaagttatctaattcacctgatgggtgcactgtgggagacagagcctggtggtgatggggggcagactgaggtgattcttggatgcctggctaagggtttagaatttaccctgaatataatgttgatatcaccaaagctttaagagtggagagtaacatgtccaatgcgccccttgagtaggagagcttcccgtataagcaggaaactcagaagactggaatcaaagctcaggtggaaggtgataaggaccaggtgccagggatggagacgaaccaagagttgggcagtggaagaatggaaaacaccagagggccaggtatagtgtcagagattgttttatgtcttacttagatgagacacaaaataatattaaaagtatgcaggataaaactctgattatctttcaatccttctaattagtcagtgaggaagtctcatcttggtgctaataggtcttcaacacctttctaacacttgctaattatttaaaggagacaataatatactgtattagtccattctcacactgctataaaaatactaccagagacgggtaatttatagaggaagaggtttaattgactcacagttctgcatggctggggaggcctcagaaaacttacaatcatggcagaagatgaaggggaagcaaataccttcttcacggggagacaggaaagagtgtgagcatgcaggaaagactaccatctataaaactatcagatctcatgagaattcactcactcactatcatgagaacagcatgggggaaacagcccccacgatcaatcacttcccttcttcaacacttggggattgcaattcgagatgagatttggatgaggacacagagccaaaccatatcatatgctaagtgagacttggcaggaacagtagtttgttatattttaatattactactgtaatctttatttttggtttttttactagtggcaagattttgtttgtttatttgattgttagtttgctgttatcttctgcttatcataagtgaaactggttttcattattggcagtgatataccattctcttttaaactatatttatttttatttatttatttatttattttttgagacaggatctcactctgtcaccaaggctggagtacagtggcccaatcacagcccactgcagcctcaacctcctgggctcaggtgatcctactacttcagcctctcgagcagctgggaccacaggcatgtgccaacacacccggctaattttcatattttttgtagagacaggattccaccatattgccgaggctagtcccagactcctgggctcaagagatccacccgtctcagcctcccaaagtgctaggattacaggcgtgagccactgtatctggcatcattttattttaagatgtaaagaaaagtattctggtggtgggagtagggggatatctatcctcaataagtcaagcatagtattaccatgtgacccagcagtttcactcttgggtataaatccaaaagaattgaaaacaggtgttcaaacaaaaacttgtacataaatgtttatagcagcaccattcacaatagctaacagatggaaacagcacaaatgcccatcaatggttgaatagataaattaaatatagtatatccatacaatggaatattattcagccatgaaaaggaataaagtactgattcatgctacgacatggatggaccttgaaaacattatgctaagtgaaagatgccagatgcaaaaggtcacataacagacgatcccatcccatctagaacgagtaaatccacagatacagaaagcagattaaaggtttccaggagctggaggggtggggaaatagatcgtaactgcttgatggttactggtctccttttggagtgatgatgttctggacctagatggaggtgctggtcacacaacattgtgaacgtactaaacgccactgaattgttcactttaaaatgtttagaatggcagattctatgttatgtgtattatatcacaataaaaaattagtcaaagtggccaaaatgttgtgaaggtgccatggaaggaaacaaaacttaagaaattcttctgatcaaaaaaacagaggttgtggagtcaggagacctgagttcagggcccagctctgttacctgcctaccagcagtgtcaccaaaaataagcttctgtgattccctgggcttcactttcctcctctctacaatgagggtggtggtcctcggatccctgcctgcaacactctgcctgcacatcagggagctcaatatacatccgtccctcatgttccttccaagcaaggaaggcttggacaacaggaataccattgacagagagaagaaatccagaataagcatgaatcaaagaggacaggcctgggcaggttcagtatgaggcacccatggccatgtcaaggagagaagcccaccaagcacctaggggaacaggtcaggaacccagggcaagaggttgaggctacaactgtagattgtggaggcatctgcaaagctccaactactaaggactatatctagagaagaggagctgatgggatgcttggagggctctcgcctgtacagaggtgtaggtcccccaagcatgcaaaaggcagatcatcatcaatgaggctggagtgactcctgacttccaacaagcagcggagtctgtcaaggagtggaccttagcccaatcccattttacagatgaggaaaggtaaggtccagaagggagagaggaaggaagaagatacactataaaggtattattttagatagataatatatattattttatagatagctaaatgatacacaaatatattattctttgtgagagagaatatgaaagctcaaattccatcccagatcgcctaactcaaagctccacatttttgcaatacaaactatcgttctcattatgtggaacccacccaaagaaggccagatattaaagctgtaagagcatttagcccaactttcttacttgcaggagaaactgaatttcagagtttgccgcaagtcaaggaatgcagttctggaagctagtaaaggaaaggaaacagactcttccccagagtctccagagggagcacagctttgctgacaccttcattttggtgcagggaacctgatttcagacttctgccctccagggctgtaagagggtaaaagtgcgtttccttcagccaccatgtttgtgatgataatttattacagcagctgtagtaaactaatacaatcctggacctagccccttctcctaactcactattttgtttgaacatctactaagtacctactctccctcaaaacaatgttctgagtgctggaagtatagaatgatgaagtcatcaatacaagcgggatatggtctccccaaaccaagagaacaggagcacacagcacaagtgggcgtggaccaagggcatgtgaactgtggatgggttgtagacttgagcaagttcgtttctagcttctaaattccaccccagcaagtaccccagacctggctttaggaaccacgatatggcagcatgaagtggggacctcatgacaacacattctaagtaggattttggtaacaagaaggatcaaagccccatctgcatctctcatgtcatctctgcattgttgatgattcatctttttcatacaactgcttggagggcatcagagactttcccacattcagcggagccagagattttggctgttttaatgaattcttctaaccggttgcaccgccccaaattgaccgtaaaagttaacagatttgtttaagaaacaaaacttgatctcaatatattgtggacaaatgctcaatcgaacagaaagctcactgttaatttgctcttcctccttctgtattctccagctatcctgaatttcttgtctcttctcccctccaggcacaaaaatgataaggaaactttgcttgggaagaatttcgcagaggcacgttcgtggagccaggttttggggtttcgggtttcaaagtgcataccaccccagggttctcaaacagaggcacacacagcccagcagaacacacgtgcagagcacaaatacagtagaacttcctagagcattgcttttacttgtgatatggtttggctgtgtccccacataaatctcatcttgaattgtagttcccatcatcctcacgtgttgtgggagggacctggtgggaggtaatttaatcatgagaatggttacccccatgctgttctcatgatagtgagtgagttctcacaagatctgatggtcttattaggggcttttcccccttttgctcacacttctccttgctgctgccatatgaagaagtacatgttggcttccccttctgccatgattgtaaatttccggaggcctcccagccacactgaactgtgagtcaattaaacctttttcctttataaattacccagtcttgggtacgtcttcattagcagtgtgagaacgaactaatacaacttaactatttgatgaagggaaaaatggacacacttatcttttaagtcattttaaattatttcgccttagtaccaacatagttacattatgaggtaggaaccaaaatctgcatgaatttttaagatcaaattcagagaaaaggccacaaagggcacagcctgatgtgcagagcgtgtgtttatcagacgctgtccctgtattggcttcctattgctgttctaacaaattaccaccaatttagtggctctaagcagcacagattctttctcttatggctccagaggtccaaagtctgaagtgggtcaagcagctggcagggtggcattccttccagaggccctagaggaggacctatctccttgccttctccagcttctggaggatgctggcattccttggattacagccccttcctccatcttcaaagtgcatcactccaatctctgcttctgttgccacatctgcttctctgactctcacctccctgcctccctttcataaggaatgattataaattggactcacctaggctaatccagaacagtctctccatttcaagatccttaatttaattatatttgcaaagtccctttagccatataaggttagtattcacaggttccaggaattagaatgtggatgtctttgggtggggaagagggggtggtggggacatgattctgcctaccacaccccctaggactatttgagtaaaaattcctgagaagcattgaacctagaagtcctagaagggttttaggaaggattctaagacagggactcagttcctcaaagcaggagcctagtgtccagaaagggagcccacatgagaagaacaaagtcagtgttagagcaggtggaggtctgggttctgagctgaggtgtcttgactccactgaggctcagttacagaagaggagtgaggagaagccttggaattaagctctaactacctcccaacctctctgtattcattttcccaggctgctgtaacaaaggatcacagtctttattacagcaaagatggtttaaacaacagaaatgtaatttgttcacagttctcaaagctagaagtctaagacaagggagctgcaggattgctcctctgaaaactgtctccttggcatacagatggccatcctctccctgtgtcttcacatggtcctccctttgtgtgtttatgttgtgtcttaatttcctgttcttataaggacaccagtcatgttgggttaaggcttacctatatgccctcattttaccataattactcttaaagactccagctccaaagtgtcacattcagagatactaggggttaggacccaatatatgacttttagggagatacaattcagtgcattctcaacaataaacaacatatcagagggttctcctaccctcggatgaaaccagagacgtgcttctttctcctgaagcccatttgaaaacctccatgaaccaggacagggatggaggatttcctatttcggaggagggaaggaagccacagactctacaagtaaactaagcacatgatcccacgaaggcacatccaaggctctcttttgaaagttgatctttaacaaagttaatttaggctgtggagtattttttggtgagttaaaagattatttttatgcttctgcaaatgagcacatcacaccccaaaaccagagactaaaacagccctcttcattcaaccccaatgaaaacaggaattgtttgggaatctcttgccctagaagacagggaacatgggagtggggagtgggcggtggcatggacagctggcttcagctcctgtgcttttcatgggagaaaggcaggcttatgatagacagctagaaaattaacccacaagagacaagccaaagcaccaggctcagaaggtggaaggttagaaggaagcacatttctgttttcatattttaggaaagagatcttcaaaatgctctcagccctacctccctttttcagggcatggttaatatatggcagaggagacagccatcctgtgtccttttctaaacagttccctgagaaaacttctgcatacacgttggcataaatgacacgtgagatctcgctgatatcctggctggtgtgcactggtgcagcagaactggttatttaaaggctgaaatgcttccgttttgcttgtgaatagccacatcttccaggaaccccaagtgccccctgccactcagcccctcccttgggaaccccctacctccccataaccagccactaaaggattaacacctcacataacaggtgctccagaattctacaaagtgagtgtctattctgattcagctgtgataatgctgtagtggttaaatattttgagtattcctcacagctgttaatatcaaacataaatctctcccacttttgtttaaaactcattttactgccccctgccacctgggcaatatccctttcctatcacaaggcagttcttgttacaaccttgtggggattcaatcagactggtgggaaaaattttggttatagagaatagccacaaaccttcttggaaggcctgaaggtttttgcaaaagtctgagaataagtttatggcttaaggcaacctaatccttaccttaagtaaatagcttgaagtgggtacaaaggaaggcagagcagtttatctaactagcttgtttactcacgtggtcttaagaccaatatttgatcattcttgagtgcatgatggctctctccggggtaggggcaaccaggttaattacccaccaatgtgtttactcacaacctttgtcaattaatatttactgaataaatgtgagtctcactggcaagtcgaggccgtggccactgactctgtacagaaccttccttggtgtctgtaagtggcacggacactcagctagactggcaaagcagaatatctgtgcgtcagggaactttattcatctgtcattgggtcagggtctgcgggacggaccccgcaaaacctcaccctgcctctgcttttttagagaaaggaacaaacaagggcttcccatccctaccgttccccacaaagcctgggacacgaacatgactccagcccaattggacgtgagtctctacctagactcctggcaaatcataacagtggggtcccacagaatgattttctgctgagaaattttacatattaaagcaatgattgaaacaacactgatacagagacaatgggtgagcaatgcctggtgatgaagaatgaataatcatagaactccccgccaggcttcaaaatatttattattttttagaaattcaaattactccactgtatgttatattggaagccatcattgtctgaggttttccatttacacaatgagaaatatcaaagcagttaaaatatgcaatacctagggaatataaaagcgatgcttaaattaaaatatattccatggcaggtgtcttaaaagagatgcaaattataacaatgagttaatatttttgtctagccaatcagaaaaatttctgtttcaagagccagccagagttaagtgacagagatactttaagacatagttattagaagtgtccagtgattcaatctttctgggaacaaattaacggaaccttaattggttctgtattgatagttttaaaattctttaatttcagtaatggattctattaaaagccaataatctgtgatgtagacatttcattacaaagatgttaaacaaggtattggttttcatggcaaaaaattggggaaaatctaaattatcaagtaaatcatgagatatccacagaatagaaaacatagaagataaaaatgtttacaagtaatctgaaagcctcatgataaaatgttaagcaaattaaaagctatctataaaattatatagtgtgtatttgtaaataaggtataggaaaacagactagagggaaataaaccaaaatgttaatagcagttgtctgtggatgctgagagtaaaggtgatttttattttctttatactgccctgattctcacaaaatcctctaaaatacatatgtatagattacttgtatattagctgtgatttttttcaacagttcttaaagttcttatatttttgatatatatatacatatatatatatatatgtatatatatatactgacatatttactgatgaacacaatgatgtcttggatttgctttaaaatgatccagcagtgggtccatgataaaaatatttctttcaatgctgctaaacaggagagagacagagacagagagagagagaagaggagaggggaggggaggggaggggagaaaggaggggaggggagaaaggaggggaggggagaaaggaggggaggggagaaaggaggggaggggagaggagaagagaagagaggagtggagaagggaggggagggaagagaaaaagaagagaggagaagagaagaggaaaaactagtatcaattaaccaaggcaaaaccaatagcaaatttgtttttaactaaagtgcaaatttgaccatgaaggtcttcacccaaggcctgccattttcaaaatcccattcatggaagccatgcacacaccctaacaccagaactacagcaagcctgcctttttccacagctccacagcttcttcacatcgttctgagtctactcacccaagtcagttaatactacatttcctcagtcctacagatatcttagcattaaaacaattcgccaggaaaatatgtctttttctttcacccctaggacagcagactagcaagacgatatggatttcaaatgccactcactcttcctgggcaggtattcctaatttgaagagacaagatagagcaggagacattcagccatttgtgacaacaaaacggaaatctgcaaaaagctcaatgtttgatggtaagaaatgccatccagaggagaatttggaagctttcaagaccactcaagactggcagccttgaggaacaggttaagaggagaggaaggcttagattgtgaactcaattctgctcctccatgagccagccttccctctacagctcatcttcagctgtgggggatgacaacctgtaggggcaggcacccaggacacaagcctcttccagaccagctctccaatttgaccccagatccctaccctcagacctgtggatgaagctgtccctcctctgcattcccatggtcccgtgaatacaatcatactgcacttgcattatgagtctctccagctagattctgaaacaaattgataacagatgcatccacaaagcattttggtccaaggacaaagccaagaaatgtatgaagaatgaacatacatttgacctgtgaacaacacactgcatgcgtctacctatacgcaaatttcttctccctctgccaacccctgaggcagcaagaccaacccctcctcttcctcctcctcctcagcctcctcaatgtaaagacaaggatgaagacctttatgatgacccacatccacttgaatagcaaacatattttcttccttacgattttccttatgatcttcttttctatggcttacttaagaatctactatataatacatatagcatagaaaatttgtattaattgactgtctatgttattggtaaggcttctgatcaacagtgggctatagtttatgggaatcaaaagttatacatggattttaaactgcatgggggttaatgcaactagcgcctgcattattcaaggatcaactgtgtttaataaaccaataaataaatcaaatccaaggaagtctatgaaagggtttcagagggtctgtgatcccctgaaattgcacataattttgactgcatgtttatgaacacgcactcctctggaagggtccgtagccttcattagattttaaagtggtccccaactccccccaaaatcaccccaaattatcttaaattctttgagtgagtttgtgagccaagcttcaaggtgtcagtgatttttggaaatcacaacttacattttagagtgagtttatttttgttttggcaaaagagtcactgttagggaccaatggaaacaattaacctttttcaagtcagggattgtagttttcaagtcagggattgtagtttaagagaagatcctttccatatgccgacttcagcaaaaaaaaatcacaaacagaaagaaatttccattccaattaatattttccctcctgaaatgggtaacatagccacctccatggaagggaacctgagttcgaagatctacgatgcattaatggagcaaatattctttctctgaatgctctattgtattatttaggttttttcgctctgtacatcaacatctatttcaaagtttaaaaaatggagacaatatatcaattgccatcccatggaaagttccaaaatttgaacagaaagtgaaagcatttggaaagcaatttcaggttcgtttttctttggggggatgtgggggaataggagaagtggataaacaacagaatagtatctagagtattttctgccataagcagatgttccaaatgcaggagaatacaactgactaaaaagaataatttgtcaactgaaaaaccagagaggagtctggctggctctttagaatacaaacatattactacagtaagatgtgcaaaacaagctgaatatactttattaagtaataatgattaacctgatacaagtgcaaaaacaccccatttcgagatcattggcaattattctaaacattgtcttctgtagatgagcttcttagccaaaaacattttcactagtaaatatgaggccggctgacctacttatgtttttatttatatatgtgtgtgtgagttgatatatacataggttgtctgcttttcaaatatcttctaccttcaggataatgtaaagtcttttgggaacttgaggtgatgatgcagggattataaattcctcctccatgccaggcaaatttatactgaattactcacacacttggaaaaagtgaggatgttggttttcagccaaatgcttggcctaaagcaccaaggcttggagatctttttttaaaaatcaaggatttgagaggtacagagtgtttgaataagaaagagcctcagaggtgacccaacccaaccttgcaagcccaattttccacctcattcctgagggacagacagtcactgttagctcaatcatatcctgatatagccttcctattccatgaatcctcacagtcttctgttagagacctaattgccgaagcttattcctcatatcaagatgaaactttactccttatagtttcactcttggccaggtgccgtggctaacgcctgtagtccagcactttaggaggccaaagcgggtggatcacctgaggtcaggagttcaagaccagcctggccaacatggtaaaaccccatctctactaaaaatacaaagttagctgatggtggtggcaggtgcctgtaatcccagctactcaggaggctgaggcaggagcatcacttgaacccaggcggcagaggttgcagtaaaccaagatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatatcccctctgagatttcccttctccaggctaaacatccctaaatacttcttctgaaactcttaatatatttcatttagagtctacgcaatcctaaaggccctttttctgcatgcattgcaatttttcaacgtccatctttagatatcactcctcggaactaagtgcaatgctacatataatggtgttagtgttgctggagacatcaccagttgtaccactgaagcatcaccccacacccttgctaacagaagcaattttgctcagtggcaattacccattctcagagaggaatcctggatctctatcattgttgtttgagcagtgggaatgtgacccagttctggccactgacatgtaagaggaagtctactccaatgaaaggatagaggccctagaagaaggcttatttttctctccctttttttccagttttgaatgctaggaggtgaaggtgtgatggctggaacagaagcagccatattgtgactcagataaaccagcagctgaggaaggcaaagtagaagaatgggaaggatctgagtcctcaatgtgacattaagtcactaagctagatctgaggctccttactaagcaaaaaactgaatgtctttaatggtttaagacactgttggtcaaagactctgttacttgcacctgaaagcactccaaacaacagaagaggtataatggagctatcacctcccttgatttaaacattatatttctataaatgtggcctccactttttataaggccacaacgtatgtggcctccacatatatttctagatatgtggcctccacatatccccacttaggatctgctgagcttctggtcaatacaaaataaacaaacaaacaaataaaaagtctgtatttgagcaccatgatctcaaatactcacagaaaccatatcattaacataaatgtatgaatcaccctagatatgggataacagagtggggacagctgtagtgaatttgaaaatgcatgctgtctaaagacattaaaattcaagcatttaaaaatgctgtactggtgaaacaaaatgcatctatgagccagattcagcgtgcagtacaccggttcatgacccttgcaaaaaccattcccaagtgagttggatgtgatagttggaacagaggcagccacattatgactaagtgagttgcaaagtctcacatccccctttctgcaatagtgaaaattcttcttcaaactattgagagaggttggtcaaaaggcaccaacttccacttgtaaggtaaataggttctagagacctaatgtatagcatggtgactggtgatagcatggtgacaatacaaaaatatattgtatacaggcaatttgctaagataccacatcttaagtaatctcatcacacaataaatgtaaccatgtgaggtaatggatatgttaattagtttgatggtgacaatcatctcacatttacttgtatatcagaatatcatttggggctggggacggtggcttatgcctgtaataccagcactttgggaggccaagggaagaggattgcttgagtccaggagttcaagaccagcctgggcaacatggtgagacccccgtctctaccaaaaatttaaaaattagccggatatcatggcacacgcctgtgttcctagctacttgggaggctgagatgagaggatcacctaagcccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagtgactccatcacttcaatctgaagttttgaattttaattccatcatccaacatcttaatccttttagtcaagacaaccaaaatatgaacatcaaaatctgttatttgtcttgcatctgagccccttccctaaatcaaatgtattcgtagtcattaacttgaaagggtaataaaataagagcaaaagaataagaacccaaagccctaggttctagttacagctttgaacaatgcacaaattactgcaactcccagatcctttatttcctcatctgaaaatagagattctttaaacaaataccgttggagctgccaggtttcccaggctatcactgagttattaatccttggcagagataaaatgagaaactatatatgtccacactctaaatccctaagcctcgtgcaaacatatggtccagttggtggagtcatttagtgcaaaggtcaatgagatagtcttctcctgcgatcactttcatgctggccacatttagcttccgtttgccaggataaagctctcagcaagtcctacaaaggcaaaggaagcttctgattgtctcagttaagaaaatacaaatcatttcatgttagaccctccacttctgacagttctgtgggattcactcccagtttctttcagagcataccctcatgtaaccacatcatccttaatcactctttctggttattaaaaagtacatgtacactggagaaaaataaaaactaaaaaatgcagacacaataacaatagcattcctgtaataagcatttattataaggtaggcactgagacatggactaatatccatgatgtcatttaaatctcacaactctacaaagtggatgctattattgttcccattttagagatgaagacattgaggctcaagatattaagaacttccccatgatcacccagccagtaagaggtggaatccctgaatttaaattcaggcaatctaactcaaagtacaatatattaaccacttgataatgacattctttaaaagattaaagcagccatgagtctaccaccccaaagataactgctattcatattttggtatgtttgttgccagtctttccttgatgaggcacaaaattttcagagctggaagagatcttagtgataattttgtcccaaatcctcattttgcaggagaaccagaggttcagacaggtgaagggccttttctaaggtcacacaggtatttttgaaaattgaatttcattcttcagactctttgtccaaggttttcttggatcttccaactcaagttgattcatcatggctgcctggagtactgtgttgagaaggccttaaggccagtgggctcaacagggccaggtgttataggagattaatgatggcagcagtgaacatggcatccatggttgcatacatgccatagatctgccgtcttatccaggagcagcccctggaagagctacttccctcacctacatcataggcctcacagccaagtgccttcaggatactgtgtatgtaacataaatgagtgaagtgaagtgaagtgaagtgactttggggaatttaagaaaggaggggcacctgtcctgtcccaggatggcagtgggagggcagggatcgtggcaggtggggttgggggatgagattcatctccagccaactgttgccatagggggaatcggggccagtatggccaggccttctgactgtttcaaagcagcatgaagtttggattttcttttcaatgggatgtcttccaactttaaaatgttggcaaagaattagaagttgaaagatcaaggatgggggatgcaggacaaacaaaagacaccaattaataaccttataatgtctcatttatgtgatgacttatcagaggctaccaactctctattacaaaccagagattcagttcctgtttctcttctgcacagccctctttctctctctttccccactcactctgcctacagtagcattttccatctgaggctatgagaaagaagataaacaccgctgcaaacccaccagaccacagctcttcagggcccaaacgattgtcagcaacccctgagggctacttggagtgtgagtcacgctaccgggaggacgcctgttggtctctgatgacttaagtgaggaggtgttgatgatcgcatctgacatgcctcatggaaaagactaaagataggtctccccactctcccaggaactacctgatgcctctttagcaggagctgagtgggctccaccaacattccgatctgtgcgtctgcccttttcgagagctctcagtgtttaatgggaaggcccatcactcgcatccaaactctggagctgccaggttacaagagcaccaacttccacctcctgctgatgagctgttactcagcagttctctacaggcctttcgtatgtaaccccccaatttatgctaatcctcaggatggctggtaattatctgcccactagagagaagagaaaaattggcaaacacctatgaaatcagtcagcattgagggaacaaacactgcacgaatgccctgaaccatattgtgatatgttcatccggaagctccaacaagctggcatcggagccaatgactagattcattcaatcaacaaacatttaccgtgtaacaaacgcaaagggcaggacaagtgtgaggtactgaaaaggatgcccctatggagcacaaatgaatattattaatggtggaaaaagagagaaattgttaaaataattgtggtatgaactgaacactctgcagccattgaaaatcaagtttaagaagtctatgtagtgataaaggaaaattccaagaatacataatcaagtttaaaaaaatatataaaagcaggttgtgaaataaaacggggtcaaaatccgagtgaacacactcagtaaccttccttttctgctcctaagacatagaatttttaaagaaacctttagttatttttaaatttacatagtattgcttgcaaataagaaaagagaatcacagatcaaaaatagagagtaatccctaaaaataaatgaactgaaagacgggactctagggtttcaagtaggaatcaaagccacataatccatggaggataggtccaatatgagccatgagaacagaggtgtcaatgtccatccagggaaaaaggggaagaactggacctagaatcaggctgctagctgtggatggtgctggaacatctgcaccatccaccattagtcacagccaaaaagcaggaccctatctgtgtcaaggagccaaaatgaagtcacctacatgagatggactcctaagcctgtaccacaggccacgtagaatgggaagagagtacaaacctgagctgctgacatgggctctggcttaaaatacacaccctcacagatacagggcataagaaatcataaagttgccttgaaaataagttcacaaacaaaaattaaagaacatatgtgaacatccaactaactgattctacaaatgaaggacttcacaactgaagaaggaaagatgctagagcaatcagagaagaactttataatacatattttttaatctttgaagggacaggggagggagttacatgcacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgattgagaaattacacatatatatatagtacagtcatgtgctgcataaggaggtttaggtcaacaatggaccacaagtacacaatgctggtcccataagattatattctaagtttttgctgtaccttttctgtgcttagatatgtttagatacacaaatactcaccaatgtattacagttgcttacaatatttagtatagcattcatacagtagagtatgctgtagaggcttgtagcctaggagcaagagcctatagctcatagcctaggtgtgtaacagactataccacctaggtttgtgtaagtgcactctgtgatgttcacacgattaaatcacctaacgatccatttctcagaacgtgtcccaccatgaagcaacgcatgactatacatatgcatgtatattcagaaggagagaatagaaagaatgatggaaagaaagaatccaacagatagcggctgagattttctccagaattaaagaaaatcttgaatcctctaagaaagtccacagagggcaaagcacaataagaaaaaccatatatactataaaatcctgagcatgcaactaaatagataaaaggaaatacaccaaagtgtcagtaatgtttacccatggtgataggatttggagagagatttttatcttctttaaatttcaatgtatttcctaagtgctctacaatgaaaaggcattatttttatatgtctgcggaggagagaagcatttgtcatgtcaaatacacatatacagataaacagtttttttaaaaatctgccctcaaacgacttacactctggcagaagacatgaggcttgcataggaataacatagaaaacgaaacccaagtgataactggcatggatggatatagctaaaatctgagcctcgtcttttcctgcatggagcaattaggaatatggggagaagtgatggggggtgagagggttaaggacactgagcagaagtgtaaagatctagcccatattctgggcttaccagggactattactgcagctggagtgtatttcacttagacagggtcaaaatggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctcagcctcctgagtagctgggattacaggggcctgccaccacatccagctgatttttgtatttttgtagagatggggtttaagcatgttggccaggctggtcttgaactcctgacctcaggtgatccacccgccttggcctcccaaagtgctaggattacaggtgtgaaccacctcgctcagccttattttcacctctaatttagttatattgcaagactacccaatgatgcgagcaaaacattagcacctccattgtaaattaaattaacaccacaaaaatccaccacatttgcatgacatttcaattgttataaggctttgttattttcttcaatggtcaagtagacagacagaaggaaaatgtggcacatacacaccatggaatactatgcagccataaaaaaggatgagttcatgtcctttgtaggcacacggatgaagctggaaaccatcattctcagcaaactaacgcaaggacaaaaaaccaaacaccgcatgttctcactcataggtgggaattgaacaatgagaacacttggacacaggaaggggaacatcacacactggggcctgtcatggggtggggggaggggggatggatagcactaggagatatacctaatgtaaatgacgagttaatgggtgcagcacaccaacatggcacatgtatacatatgtaacaaacctgcacgttgtgcacatataccctagaacttaaagtaaaaataaaaataaaaataaaaaaagttaaaaaaatgtgtgtgtgtgtgttcattttaactgataaccaaattgactactattcttaccagcaggggcactatcatgttgccaatgtagaagtaaatataacacacgtgtgttctggatgactttaccaaatcaacatcattttaacaggaggcagaggccttgtcaatctaggaaggttgaggctgtagtcataataccatttgcaagcgaggcaaggcagagttttaaacaatgcaccgtgactgtttctttggagacaaataaactcaatgttcagctctaaatgaaacatgtggcagaagcacaagccatctatatatgttactaatggaaggaagggctgttcacctctcagacaatctcctttctaaatacatccccagtttctcaaaatacgaccttttaaaccaacttctcttggtatcacccaactcctctcaatatcaccgttccacatggggaccagacatataccccgatgttacctccactgagctctttgcttccctgccaccttgcctcatctccctacagttccaccagaatcacagagagtggccaatgtctccaagaccaactctgaaagtcccaacaacaatcaggagtatcgaatcccctcctccatttttgaaccaatggaccctttcattcttcttctctccaacccctcttaagtctctattctttatttctctggaaatgtcttttctcatcttcctcttgccctttcctgattccttttctcttcttactcttaagtgaggtcacattttggtccacatccccaaaacgcagtttcatcccaaaggagagaagaatgtttccacccatactccctggacttctcaaaactttctttctaatgcccccttcaagggaagaacagttgctggtctagttggtcacaacctgccattcactgggtcaagattcactagcaggcagggtcactgcctatcaagggggttcccttccatgaccctacactcttccggcttctctctgcctacgttcggatgaatgagtcacatgacagcctgagccacacacctatcgactgagacttagaagtaagagccaaagcctacccggaacctcccagtctcacaccaccttttccaattcagcttttcccagatttctccattgggttgtgccaaaccctcatggatccagaaatttcactttcagtatggttactgtttccagtctatcactcctttagaaaaactcaagaaggaagaagggatccgtggtaatatttaaatcccaaaatcatactccaaggcgtggctggaaactggctgttcttctccctcaatgccttctttagaagattggcccctcccatacaaaagccctctaggctgtgattcatcatagctctccatgctcagcccctcccacaaaatgaaactgatcccttgtccctcctgaagatggatgacatcattaaagtatgggcttgatttagtggaatggaagatcacaccttgggatcagaaattcagctacctagctacatcagccactatgtggtcttggcaaattcccttaactcccctatggctcagtcacttcatctgaaagttacagcatgctccaagaaaccctaagatgctctccagttctgaaattgtcagtggtggcagagcatggctagtccctactctcttcttcccagacaggagccccccaaaactgagaagtgactgggaaaatgctcagctacacacaggaattctgctagcctgcaaatcatttaaaatgaatgtttaataagacactgcatcaattgtgtgctacagctgaatgtgctgcagcccaggagacctgaaagaattaatacggttaccaaaggagctggtaggaatcgctgaaacagaagcaaaagctgatgtgatgaatataaaagtgctttgagagcatcaaaaggaaagcgctacagtgaatgtctgctcactccactagaatatctcctgccatctaaggaacactctccaagaaggtctcagggctagaggctatggcacacaagtacacttactctttcctcgccttctgaactcccaatcttttctcaggacttagaggacagtacacacacaactccaatctttcccttttttctcattcctcactttacttcttcattccagccttcttccttccctccacttctgtgtaattcccaaaccaggctgtcataacatcgccttcaaatcttcaaatctctctcccttcttctccaaaccaaagctcccaggctgtccacaaaaaagaccctccctctcattcagagccaactgatttttgtacactctttcttgcattttgagactctccaactttagtaccaagacccatctttgttcaggagccaactccttcatctgagggccttggagccccagacaaagaacacgtaaggaaaatgccaggccctccatgctctgggtttggagttaattctttccactcccacccactccccttgaggaacgggtctctcctccgctcctctggcccagggcttctcaaactccccacctctgttcctctaactgcagagtcagaggaagcatgacattttttctgcccttttgtgctttacctaaaaactttgcattttcttccagaacctacccacatttaataatttttagaaatagttttagtcacttaccataagaggaaaaaatggacattttcccacaaaacaatcaggtaaaactggcattgtgaaaataggaagcatatgtctccagtgctcctgggcccacctctgtgccccatggtactcgtaaatctccaaacatgccaccaccgccaccaccaccaccccacagcctacttctcagttttctgagcgcttcctggcacacacacaccaaagtgctcctgtgtacaccattttcagaaacaaggcaaaaggcatttccattcatttctgggttggagaggcaagacctggttctcaccagggccagtggccacgaccctcccacccccacccccacttcacatcaagacagattctaggggcgtccgaagacctgcagcagctgccatgcagctggtggcttcccaggtcctggcagggcatcagtttccggccttaccttgtcagccatgatcatagatgcgcccccatgaatgcccaagatggggacgaaggtgtgggaggagataaaatccagcatctgggctacggcctcctggtccgtgtcgtccccaaacacgaggccgtggatgcgtgccccggacatgaggtcgcacacgtgcgtgatgaggctcttggggtcggtgcggttcatcagcagagctaccacgttcacgtccaggggcagccccgccgcctgctcggggccccacagtgttcgaagttcgcgctctgtcacgtcgtggctgtgacccagcatcaccgcaatatttagcgcggggggacccttctccgccgccgcgctcggcgccggaccgcgccagaccagaagggccggcagcaccagcagggtccaatagcccactctgcccatagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaaggagaggcagggtcagcccaccaacgaggggagggagggttgaggggaaggctgcagtctgcagtgctcacaagcccccctatgcgcccaggggggctagacaagaggggggaagctgaagcccgatgcccacgacgcccccagtgcggatcctcagcccctgtggctgatagcgggagctccactccagggtgcacaggagaatgggagccccaggttggccacccacgagaagctaactgggcacctccacccgcaccccctaccacctccccagcgccggctgctgggagttgtgcgaccgggagctgctgagcgagggaggtagggagagaaagaggaggtaacgagggtgggggggcgctggctgagtttgtgacgagccagcagtaggagagggggagggaaggacgcgggctcccgcggtcccggttccccgagggaggtggatctttcccacgcagcgaccctcttgtgatcctgccgcttcctccctcttcaggcctcccacctccccccttcccaagggggcctcccaggcccggcgtcccgcgctagcactcaccgcagcctctctccacatagttctcagcagtggccgctcctggtcatctccagggctgatggctgcggccgcgattctcagcgctcacccggtcccatgat

SEQ ID NO: 785 - DNA, 419394 bp, Homo sapiens
atgcattcttaactgtttttattttgtctgtgtcaggtttacatgcacaccatattgcttattctgtattagagaaaccattaggcatttctgatgagaaaattacatggtgggctgaccttaatggaatttggaatataggaaatcataacatcaccattggcatccaatgcatcattattgccaacatacccagtaggcatgtcccggagacttgcccttatgtagttagttatttttggttaaggactcacctatctggtgtctgccatgctcagcacacacctcacaagattccttgagtggaagattatggcatgaagccgtgtgcaaaagagccaacaacaacaacaacaaaatacctccctacatcttcttcctcttagcagggcactattggacatccaacatttaccctccagaacattggccattacgtatatttccctatagataaaacattaatggaagatttttaaacatcagattcgatactaggcattttcttgtacacgcgtctattgctgcaggaatttaaaaccctgggggtagagtacatattattcttatttgcagcataaggcataacatgctccgaaatatacacatcattgtggccccgactgtccctggaacagtacgatgccgttgacctcaaggacgaccgaagatagctgtcattcaccgcctgggatggcaacgagtgtttgtaagggtccgaggggcatctcccaataaccaagcgttggtcatccctgtgggagtggaggaaagggttatcggaggtgtggtctggcaagagagacttgctcctcttgctgtcctccagaccttgggggaaaagggagctttttttccccgagagtttgcttgaggggacactaaacaggctgccgtaaaaatttccctccagaagccgttccctgtccttgaggcttatgctccgggagggcctgctaaggtctagctccctaggtttgtcgacaatgttatcgtaggaatgctgacggctaatccttagcttgttcttttgtaattgaagggcattgttctgtgcccagtcctgctggtagacctgctccccggtggctgggttacctgtctcctgaagcatctggtcttcatcgatgtcatagaggttccccatccgcaggcaggcatcgcacttgaagggggacctcatggtgaagtggcctgaataggtgggcatgttggaaaggcagcttctgcagtgcgtggagttctgccggtatcgctcgctggtctcactgtgcggggaacccttgtctttcaaggtgaagtgcttggagtagagtttatactggtcgttgttggaaagcccctcttcattatgcaaggggttccggttcattggcagcgtggagtcccccttgcggaagttttcactgggatcctggtaggggtccgggaagtccacgttctcgggcagggtcacattttcaacaaactggggtggatctaagtggaaaccaggctccttctcaccatctatagtgtagatcttgtctctaggggagcttgatttggttttcaggtaggtgcgctcgacctcactacagtccttggggtatttggaggccactgaccttttaaagttgtccttggttttgtggttcttactgttgtcaggttccctgtggcacgtggcccgatttgacgtttctgaaatgtcagagtgggccatctcttctggaagatacctagggctctttagggagtgggtcctattctctgctgttgcctcatccctctgggagactggattctgggatagtgaatcctggcgtatggaatccacggatttcttccacagctgccggggtctagagttcgctttggattctgtgctcacggccacctccaccgtgttagggttggactcattgagagtaagaggatgttgtccctggaatacatagttattgaggttatccttctgccggttggccacaaatgtttggagttcgttcatgttgtctccaaaaatgctctctttcccctgaaaggacctgttgtctgagtacatcaaattccccttatctgaaaccatgtccatgatgagggaacctctttggatgaagtcagcagctcttttgggtgagtccattcttgaggagttcatgttggacatgctggaaatgtttttggctgaccggaggagttttaacatgttgctctgggatcccgtcagattgaagtctggagacttcttcttttcttcaatgtgcactccatgaatgcagctgtagatgccctgtaggggagcaacataaagcactgtcagcagcagcagcagtgaacatgaaaccactttgcacttgaactttacctgcaaaggtgagatttgcacttcttgcaggagccctggagaaacagcaaaattcagtctgaatcctgataatgtctcttaaaggtatgagacaagttgcaaagcatagggtttatcttattgctctggctcaagattagctgacacctttgcaaagagtcacacatggagtttgagaaaaggtatcaaccgatgctcatacaactgtcaatgcctcagtgtctccaaagtggcatataagaacagataactgagcctcccagcacccgggtcaccaatccaagctttcattaaagtttcccagcatcatctttgaaagtttaggcaccagagagttaactactgacaaacacagtcagcatgaaaggatcatccattgttaattcttttctggaattacccctactcttatgcaaaagctaacaatcaaagaatgtgtcctaagtggccaatcagaaaatctcttctccatgcacacattgattcatctaaaggaaggcatgaaattcatgtgaggctcatcatactctttgagggggggatagatgtggatgcttggatagaaggagttgcagacttaccatcatgtgggggtgtgagcctatcagtgaagccattgcagtgaaaagtagagcccaagagatagagaaagacatggtttaaacccctggagccactcccttgaacttttttacttaatcgactcaatctattccttgtgtgtttgtttgtgtgtgagtctattcaatgtagttagaactgggttttagttactagtcacagtgaagagttctgatgacacagtgacaccgcctttaaatccatccagggaactgaatgacttaagggctcctgggcagcccaaatacaagcacctccatctatatgtcttctcattttctactctttctttcttttagaaaacaactgtttacgttcacttaaaagtagctgttcaactgttatcaagggaagagcccttgattcctaccacaataacaggcaaaaggacgtctggaacattttgatctgtggcttcccctgcttctccccactcctaccccagatttcagcagccgtacctacaggaaacagtcagatcaaggctgcaggatttgacctggtcttcccaaggctgacagggagccaaactatgaaggggtttgtagggcagaattggcagtggctgctgactttggcataaactacaggaaagtaagtgtgattaactgtggactctgataatggtggctccatcggtcccccatggtggggacaagctcaccctgcagggatgctcacggaactgtgacagcctcaactcattttcactgctacatttttcttgtagtagacagtctctccactccagccttcaaggaaccgtaaacacaaaagcctacagttgcaagtttgagctgctctttctctgatcctctccaccccaggcttcatggttggtgaaggccccctgaggctcagggcactggcattacatcctttcctgcattcctgcaaacttatctgtggtctccttctatatataatgtgtggttggctgtttgtcctgccacaaaataacatctgcccctgccatcactgcttccagagctgctggagcatccagactgtggatgtggaaatcttacaaatgagccactgcgctccagcctgggcaacagagggagactccatctcaaaaaaataaataagtaaataaatcaaatcaaatcaatcaatcaatcaataaaagcacattgctcccataaaacttggggtccttctcccctagggatggagaggccaaagttcaaattctagatgatcaagggactccaccaacaatgcctgccctgtgctgcccagtttgccttccattcccatcctttggaaaggaagatatggatttacttcatttcttaaaatgttgataaatcaacttggcttccttagcagtgttttagatagatagaggaaatgctcttccaaaaacaagcaagatttagaagtaaacgcaacagtgtgcatttgtttggtgctaatcccagaatcatttggatatgaaaagcctttggtaattggctgggagaattagcttaaagttggcataatacctagctctatgcacgtacgttgttatttttaagcaatctatgtgtttagatgccatcaagctaattaggaaatatgtatttgcacagaacccgagtttggagtgcaagtgaatggagaaaataaatcttcctcactaaactaatgtgtaccttccgaatctccacagttcttgaaactagcaaatgttaagaatatacaaatctgttttaaagcaattagttagctttctcagtaaacaatagcatataaaattagatttttatttatttatttttattattatactttaagttctagggtacatgtgcacaacgtgcaggtttgttacatatgtatacatgtgctgtgttggtttgctgcaattagatgtttttaaccaaagagttttcaccatttttcaaatcctaattaatgaagttcttccaaggcaaaaaaacaaacaaaaacaaaaaaaaacacaaacaaaacaaaaaaacaaacaaaaaaacaaggtgggcaaataagagagatgagtggataaatagatggatgcatagatggctgaaacgaatgaatggacatatagataagaaggtagatacatatgtattttgtgctgttgtttatgttgagttgaaggtaaactttgttttctgcttgatacgtgtgcattttcttctgttactttacacctgtgtttcctttcatgtgctattgcattccacatgctctttgtgttttattagatgtgtatacatattccatagcattgcaagtagattttgttttgttgggcatgttctgttacaatgcatacacaaattgtaacatcttgcatagcagcattagtagtgttatacagcatacctgggtgctagtgatgggagccacaggctggctctgtctggcccagtgtttttaaatttttttttattttttgtttttatttttttgtgagacggagtctcgctctttcacccaggctggagctggagttcagtggcgctatcttggctcactgcaagctccgcttcccgggttcacgccattctcctgcctcagcctccggggtagctgggactacaggcgcccggctaattttttgtgtttttagtagagaaggggggggtctcaccgtgttagccaggatggtctcgatctcctgacctcgtgatccgcccgcctgggcctcccaaagtgctgggattataggcatgagccaccgtgcccggccaaaaaatttttacatggaattagttactaatatttaaaaatggaaaggtttctaacaaaatcagatgacattttctctttttaaaaaactagaagacctgataatattgactctacattcccataagacaatactcagcaggagttgaggatggctgccacgctactggtgaggtaaacatcatgcaattggccacagtcctcagtattccctatcgttctctcactttgatactgaggtttagctgccgtttcacgtcatctgtgctatttttctcatgtcccgcctgctgcacccactcccgtttcctttctgccttccttagtcatctaagtttgcaacacctggcttatgaatgcacaaaatctggatgctcttgtgacatgcccaagaaaggctggtaaggggaggaagtgcagaccccactgagacatcaagaacccaagcgcttttctaaacctgcttgcagtgcaagaaagtagccacccggtgtactgaccctgctgatggagaagagcaacccaggccggtcggagcacacgcccgtgaaacagaagcgcagcttccagtagaagaggtgctcccagatgaaggtgatgaggctaagggccatggcggcagccagcatgtagaatacgcccgccatgttgtcaatgtccagctggctgctcatcacctcgttcttctcgttgtggcagatcccagtgagccacagggtctccagctcctccatctcacctggacagatcacaacattcacaggcagtgaggaccagaacatgcactttggggcagacgcttctgggtttggaacagacgatgtgcaactcacagctatgtaaccttaagacaagtttctgagtttgctgggtttccatttgctcacttcttgagtgaagataataatgattacatagcctacctaatattgttgcagtgaggacaaaatttatatataaaaatagagaatataatatatatatagagagagagtatagcaaacttattctctattaatatgtatatatattatatattatatacatatataatatatataacttagcacagttcctggttttgttttttggagttttgtcttttttttttttttttttttggtcattattatgtttttctgaccttgctttcccttacccctgcccccaatacccacccaagcttggaacaagacatgggaataaaagggcagaacgtgacaatagaaagacttcattgcaattctgacttgatcatctgctagctgcatggcctcggagctacagttatcctgtctgtgaaataggcataataatagaacatacttcctagagtcgccatgaggattgaatgagatgagaatgtataaaatccctaaaggacccagatcatagtaagttttcataagcagtatgtttgctactatttactgttgtgaagaaaatgcctaacacagtgcctggcctgtggcaatcctcaaatatgtgtgtttctttttctctctctctttagaacattcaggattacttagaaaagtcacacatgagcagcatacttagggcacaaaactttaattgaaaagagacatccagctggctctgaatggccccttgcaaactaaactatacccaccccccaacttcagtaggcaattaaagaaccaggtggttttttccaatggggggaagaaaagagtaggcatgcttagaattattctgtccctcttttatgtgcattttatcctgttgccatttaggagaaaattctctgatctatatgtctagcaattatactgtctagcaattcactaaactatggcacttagactatgattcagcctttaaaaatgatctttcaaggacagtaaaaatcaagatgtgtatgctaaatgaaaagtatgactatattttatatgtatatacatgatctctaagatgtaatggggacatgcagagaaaaattaacgaaatactccaaatgtttatatcaattctctttgaagaagtcaatcaaaatgatttaatattggtctttttttaagttatgtgaaattagcatgtattgtttttggtttgttctcactcttgaatgatatggctgaatataaaaatcaaagttgacaattatttttccttgaccttttggagatgttaaattttcctctgatctggatggcagttgttgaaaagttggctaatcatctaattgtcgttactttctatgcaatctatattttctctctagttgcttttgagaatttcactttgtctttggtgtgaagtctagatgtgggtttgttttattggttcggctctggacttagtacgattcttcaatctgaatacttagaactttagttctggcaaaaattcacctgctatggctttgaatattacttctccctatcatatcttttttaaaaagttaatagattttatttttttagagtggttttatagttacagaaaaactgaacagaaagtacagagagttcccatatactacctctccccgctcccttcggttttccctgttaacatcttgcattagtgtggtacagtttttacagttcatttgggtaaatacctaggagcattattgctagattatacagtaagtctgtgtttcagctttgtaggaaactgccaaactttcttccaaagtggctgtactattttgcactcccatcaacaatgaatgagagagctcctgttgctccaagtcctcaccacccttttcattgtcagtgttagtgttagtgtttggggttttagccactctcatagggatgtagtgctagctcattatttcaatttgcaattccctaatggtatataatagtcccatctttttttttttttttcctgaaaactttaaaatactgtggaacttttcattctctcctctaggttatttaccttgttttaatatttgcattcttttttctctctgtgctgcatttgggtaatttccaatagatgtattttcccgttaatttattcttttgttggtaatatttagctttatgttttaattttatttattttaattgtgatattcatttggttcttttacagttctgcctgttctttttatcataatatcccatccttttgttatatagtttgttatataaagtttaaaagtttttaaaactttcatatatttaataattttaaacctctagtctttcagattactcccccccacccccaccttagttcttgggattctcattcctctgtttgctgtgtgttctgactctcatggtgggttacttccttgtgacgtctgtaacttttgaccatgagctaatcttctgcagaattattttccctctaagccccatgggactcccaagaacactaggctacagaaacatccctatagagagtttctgggtttgcttctgccatggttccaggaattttcaatgtatgagtttttgtatggaaaaatttttactttgattactacaccatttaagtagcatacatttgaactcacatgctcatttgggctttaatttcttactgacagcttcaaacagatggtaaacctccttgcattttcttcactttgatggacagagattttcctagttttctttttacagactaagtgactcattaaagttctcaaatgtattaaccagaaaaaaaagcatacatgttaatgagtttttttttaaaaaaataggaaatccatccctttccagttcctcacccacaaaaatgggtgctgatcaatcggttgtgtaggtaaagggatgagaagagggtatcttgattcaattccttttcttccaacagcctcccatgctttcgcacagtcacaaagtcatgggagactttgaaataatatctcactgtccaccaacactatctcaaactcatccagatttctctgcccaccatgtacctcagacctgcacggctgcttcctcttctcacaaaaacaccaatgccatccctttggaaatacaatgtgctgttgacgtcccccctccctttggaggtattttgttttgttttgttgagatggggtctcactacagtcgcccaggctggagtgcagtggtgcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccctttggagtctgggaggacacaaaaatgggtcttctcactatgactcatcagattcccagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatacctctttttagaggaaatcaacatggtaaagcagacttcaatttcaaaaaaaaaaaaaaaaaaaaagagcaaatgcacatttctcattaccaattacagcctgttccaatcattttcaaattaatcatttcctgcctcgtggccctctttgactagcgtactgaactgtagttcaaatactttcttatttcatttttaatttactcaagtatattgtaatctcctggagggagatcagggaccatgttttatggttttgatatttttcgtggcctgcagcacgtagtgagcattgaatccatattttctgtttctgtttcttttcttacatccccaggcttaaactgggcagcattgcagaagtgttcaaatctgtttagtgagttattctgccatataaatagaaggaatacaaagcaaaggggaacttgcagcgggcttgagagtaaaaggctgggaaatgtgcatcctttaggtagggtgaagcatcaaatgtcgtttttccaaggagtggctctatgatatttattctgctgccagtttctcctattaaaaagaggccgtgatctttgtcagtgtgatcttgtgaaccagagctgataaatggggcaattaaatctctttcctgaagcagactcattcttgctgggaacacacaagctaaatgctctcttgggaacagatggagcctgggaagttttggggttgcagtcaaaccacactgcctttgtctccccaccggagaggactggtccccatgtagcactcaaagccctctccttttgtgtttccacctcctccagtgacagtaagctcatgcacatttgcagaacttctttgcgcccatgggaacttgcacctgttcttcctatatctgttttcaggggagatgtttccagccacaagtatctctactaaccacttagttctgcaccatcgtgaggaaagctgtaagttcagtagaaggagcaaggtgtcaaggtcactcttttcctaatgctgacaacattaaaagacagagtaatagagtttcaggagtcaaccgtcagagagatgcagaatctaaaagggaacaggcaagggtaattgaggcagtgttgtgtgtgtgtgtctccaacttgcttccattccatttaaaagggaacaggcaaggataattgaggcagtgttgtgtgtgtgtgtctccaacttgcttccattccattccactggctgcttgggtcaggctgtaagaaggctggttagacaaaaggcacagacaggatgcagacagtggaggagtttctcccattacccatccacccactgacaaggtggaagccaggggttttatatttgcaaaaaggaatgaaagaaaattcaactagatactgtccagcaaattacaagaaagaatgtttcaggtagaaaacactagaatgagatataaaaggaagcacccttcccttaagattttggggagcacatccagtcatctggtaaggtctagatagtaacacagaggtattaatacactcaggtattaatacactcaatatctgagtcagacggcctgcattagactcttggcttccacaggtaccggctctttgatcatggtccaggtactctactttaatctatccaactactcatccattcatgtatttatttttctatttaacaaaattacataaaatagactgtccttcaggtactatactagagtttaaaaaaattaactcatgtaaacttaatatggcttgtctagtttacagatgagggcacgcaggtgcagagaggttaaggagtttgcttaatcactctaagcttcagttttaatatcgagcaaatgggagtacatcagaatttatctcataggagttttgttagaattaaacgatgttgcatacacacagtgcctggcatacactaattacaaaatcagtatttctggagatattattattgcctgaaatcagggaagctggggggtgggatggaccacataatgctctctgtgcccttctaactcactctatctatgattccaagaacgcaagtccagggagaaggttcagctctccatggagactctcttatatccaaagtaagagaaattagttctctatttgccctaagactcattctcagcacttccagaggaactgcagtttttgggaatggattttatagcaagcaatgtgactagccttcaaacttcccaagtacctctcccctgaggtcatttgtgaaaaatccattttgaacctgtaccctttaggctttgtccaaaatttgctgaaacatatcttctaaaatcagcttccacaggcacacgtctacatattttttttttcttggtttcttgccaaagcacctgacccaaggcagtgatgaaagatgaaaagagagagtatgtggttctgagaagctgagttcgatgttctatttcatgtctggtcaaggaagctgttgctttttggttttccgaggacttcatttgttttttttctttactcattcattcactcattgaaaagagaaaatttgtaaagcacttaacatgtggcaaacatctctgtattttcatatagagatgaattacagatagtctttggcctctaagagctcattcctgtgagagagacagtcatgaaaaccagtagttacggcaaaatgagatgattggatttgcatagggctggaggcaggaagaaacaaggagtgttgagatcagagagcagttcaggatttctgggaaggaagaagggatcaaaggaggagcccgaagagtagaagccagaatgctaagaacttgattttcattctaacaagtctggggtacccagggaacagcaaggccgtcagatgtacatctgtagtgaacacccaactattttcttagtggacccaaggttcttcagttgttgctcatgtttctccagtcatggccccctgattggaaatccagtgtctcctcacatacaataggaggtaagctgtgatgagtgagtgtgcaatgtctcattcaaattgcaaatgtgtacaatggtgctaccatgtggaggaaggtcaccagtcaactctatcctggtgacacagtcactattagagtcctgtcctgatttcagagtcagacagaagacgcagcttaagctttcctgttccgaggttatgcagtgactgggagaaacgcacttacaagaaactgctggcaaggattcattgtaaactgtcaccaatatcataacccattacagtctactctggatataccagctgcatggtatttgtgctgaaaacttggcaatagctatctttggtgtatagctcagaggtatccaccttcaggaagtcttccctgaaggcacaggaatgtaaatatgacgccatggtttcctctaccataacatcctggattttttttttttttttttgtatagaatttgtcacagtggaacgtaattgtcactgggaggtgagtttattcagggcagggatcttgttttattctccttgtacccccagtctgtggcacaggtcttggtacatgtggttcatgacattgcaccaactgtggataacacaaggctcctgtctccttgattagtttgtgatccacagatctgaggatcggtcagagcccaagacaggaagaagtttgagaagccccaggcaaaggggtgaggaatagattctgaaacccagaaatcaaggctggctcttgggcgagtatgttctcatcaaagatcccagcaatagagcctggtggtttcctacagggaacagacttccatctatagctgaaagacgtcagaaggttgttgctgctgatctcattcgggttcgctgtgaacaccgagagggtaactgaccccatttcaatcctgtttcatgtcttgcccaggggttgggtactttgggtttctcagaagcccgattggaattggaaatggcaaaggaacaacttttttatgggaaatctagggcacagattcattggcaggctcatgttctcgatgacaacagacttggtcattctgagttctgagttgtggtcctgcaattgaggatggcctgggggacacagaattggggccaaatcctctccttgcccagttgtcctgtagatgaaaggaagttgtgtatcagatttggggatgtggtctgtggccttggagcagagtaagatcagctagaccatctgagctttgaccttgagggcccaacttcattaattccaccatcttgactcaaagccatgtgaggcaagtccaccctcccagatgcagcagtgagaaactcattcctttctctcttccctgtggtgacccaacacccatgttgttttaaagacaaatttaaaaactctcaaaaggacaaaacaaaggcccaataaatctgacaaataagaaaaaaaaatgagctagagaaaaataagacccaagtaaccctgggttcagaaataatattctggagcctgtgacctctgttctcacgatctcagagggtcactgaactatttgccgaagtgaaaaaatacttttgatggtggtggtgataggaaatagtacaagattctggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccgccaccttccaactgagatttctgctccatggatgaaacttgagtattgttaagttcattgctacttgtcacattgcaggatttcacaggccacgtgattagtcgcacaagttggatggagttgggggattttatgcacacaggttcccaaccataaaatctcccaactctggccgggtgcagtggctcacgcctgtaatcccagcactctgggaggccgaggcacgcagatcacctggggtcaggagtttgagaccggcctggccaacatggtgaaaccctatctctactaaaaatacaaaaaattagctgggcgtggtcgtgggcgcctgtaatcccagctactcaggaggctgaggcagtagaatcacttgaacctgggaggtggaggttgcagggagctgagatcgcgccattgcactccagcctgggcaacaagagtgaaactgtctcaaaaacaacaacaacaaaaaacccaactacaacttgtgcagcttcccaaccagtgtctctttcagaagaaaaattaaaaagaggattggacaataaaagattggacaactctatcaaacatcaaacaatacacatggtcataattttccattactggatgaagttggagagatacaattctttgaagtaagacggcagaaaccttgtaggaatccaggaaaccttattatataccaagcacttctggaatctgcttaaccaatctgcctcacacaaataaagacggtcaagctgacatggcttaaaaggcacatgcatttgtgagcacaaatgaattcatagtgactttttgccattgcatattttctcaatcaatagtcctcaaaatctgatgacttatcatgggaaggttatgaggactttttaatatcacaaaggagttcttgtgttttaaacacatacagatttaagaaaaaaaaggatagcaataacttcagatcccgtgctgttttgagagccactggctaaactgggtttccagtactacagcagctaacaaccctgccctaatgaccaacgaggggaagtaaatctgggtgtttacacgtgcctttcacaggatgcttcttttacctagtagacaacctcatgcctagttttcctatccatgaccaggggatctctcccaggaggaacttatttataactgctgatgcccttgcagctcttgtctgacccatgtccagtttatgtctgcctgatcatcgctctggcactggaagcccaaccttgtagtctccccgagggaaaacccagtctgcggtagttcctaggtcttcagatgaaaggtgcaaattcaatacaccaccatatagaaaataagctcaaagatttattacttacacatcctgggcagggagggtgcaatgaatcaagaggacagttttctgctcctgcatcacacaaggcaagaatgaagagtcagcccgagaaagagagaatgtggccaactagtggtacataaaagggaatagcgtgcgggtcactttaagtttgcaggcaaatgcctgaatgatccatttaaaggaagcagtgggaaagcatggagcctggtctcccaggttggggagatgcctctgagttcttatctctggccaggggcttcagccatttgggtgtgatgcttctcttgtaactccaaggtaacctatgctgtgttgctcagttctacatgccaagaaatagctcctcttttcagcaagtaaaattatctcactgcttttcagtttcttttttatcgaagtgttgtcaacaagttccttgaagctgtaaaatccagaagcgaaatggatcacttccatttgatctgtattccccattgcttagtatacacaaggagcttaatgggcatcggagacttagttgtggaatgaagagagaaggagagagtggaaaggaaagaaaagaggacagggaagagaaggaggaggaagaaaaaggggaatggagaaggacagaaagtgagaaataaaactattacagaagggaccctatatcagctgtcagaaccatccgtaactaaagcagaaggaagaccctgtttttctttccatagagggtaatagggtggtgtgcagggctgggttatgacttaggagagctctcagctcttcctttgatgacatcctcccgctccccaggtatggaggtgctcctctgacctcctctcccttttcccaagtctaaggcaccagatggggtgagacagtggccagggatgagtggaagagcacatgcgggtggcagagaagctagatatcaattctaactcaggaaagtaagtggggcagactccacagtcctctgcccccattgtactgacattaaatctgaggtcaggttacatgaaccaaggtcacaaaataaggcaatgttgatgttggggcaagaatctggatctctaaatgactggtggcaacagccaaccacacagccactgatgaagacacctagagttctgttgcacaagccagctttacctcttacagaaagtcgaaaaggagcacttgcaaattggagaaactacctgcactgctggcaggaatgtaaattggtttacattttcagaacactggttcaaagtatctactaaagttgagtagacgcgctctattacccagcaatttcattcctaggtatatttccaaaccaataagtgcctttgtgcacaagaaaggtacaaaaatatccaaagcagacaaaaactaaaagtgatgtaaatgcccatcagcagcaaaatggataaatttgtacgataaaataccacccagcaacgaaaaaaaataatgagctgtggttacatgcagtaatatgtatcaatgtcacaagagacatcaatgaatacatgttgtatgattccaccatttatttgaggatcaaaagaagacaaaaccaccccatggtcatggaggacagaatgttgattacttgtggggggcatattgactggcatgggccatgaggaagctttctaggatagtggtcacattttatagctcaatctgggtgggagttgcacagctgtacaaaaattaactggatattgggatttgtgcaatataacgaatgtatgtcatagtttatagaaggtaacaaatagaaaaaaacagtgagtggcatagtacaggtataagtgttcttttactttgggggttaagtgaggtaataataaggaaagttgaagaaaacagactttctaaaccagaggagagaaaaatacaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatctttttttttttttatggtaaacggccaattagtaaatattttcagcactacaggccatacggtctctatcacaactactcaactctgcctttgtagcacaaaaacagccatagacaatgcgtaatacaggaatgagtgtggttgtgttccagtaaaactttataaaaaacatgtaatgggccataatttgcagaattctgatttaaccaatcaaaacatgaaacatgaaataactttttatatttatataaaagagatagcatgttgcaccttctaaaatagcaaaaagaactgtaatgcctaatgctgctagatagtggtaaaattggtacattgatccactattactattactttagatggaaacaaaacttttttttctttgagacagggtcttgttctgtcacccatgctggagtgcagtggaaggaacactgctctctgcagcctcaacctcccaggctcaagtgatcctcccacctcagcttccaaagtagctaggaccacaggtgcatgccactatgcctagataatgtctttattttttgtagagatggggtctcaccatgttgcccaggctagtcttgaactcctgggctcaagcaatccccccaccttggcctcctaaagtgctgggattacaggtatgagtcactgcacccagggttaacaaaccttttgggcatcaatatgacgccatatatcaagactcctagagatctttagaaccagtaacctttaaattctacatctaagagtttgttgcaaatagttcaaaagaaaaaagaaataggcatgaagaaatttcttccatcgttatctatactagccaaatatcaaaatgtgtagcatttggaaaataatgtaatggtttctggtttaataaagatgatgacattttatgcaaaaaattaaaataattgtgaaagcagatagtatagttacataagaatgcttaaaatgtaataataagtgaaaaatcatggactataaaagtatatataaccaataattataattaaagaaatgtgtctgcaagtaacagggatcaggagataatacataaattaaaaacaattatgttaaagtagtagattggggtgattatatgtacagtcagccctttctgtatttgtgaattcaaatgatcacagattgaaaatattttggggagaaaatggtgtctgcactaaacatatacagacttttttttcttgtcattgtttcctaaaccatacggtgtaacaactatttagatcgcatttatattgcattaggtattataagtaaactagagatgatttaaagtataagatgtgcatagattatattcaaatgctacaccattttatatcaggaacttgagcatccacagattttggtgtctgtaggagaccctcaaaccaatcctccacaatactgagggacaactgtatatataatatattgcctttccaaattaaagtgtttaaaaaatatagactgagagggatttggggccactgtttatccatgccataaattttgcacgagcctatgtgacatcaatgtttgacttaccaacaagccattcattatatcttatttccactttgatggttctcttgacatttgactttctctggtttgagcaattcactgcttgtcaggcatgggcctggcatgctgaccttgtactaatcctggtgttggattgataacagacactaagattctgaatctcaacaggcccattagggaattcactgcaaatttacgcagattaaatcccctggagttttaccactgaggaagactcagtggctctccaggatatttatggatattatctgtttcttaataagtactgttccattattattccaaatatgtctctagttaaaattaggagggaaataaacaagtctaatttttatggtatcatctggtcacaggccaatggagaagcagttaagtcctttattgctaatctatgcttagaactgacatatctcttatttgaaaacgttgcatttctgaataaatggtttgccctagacagtttttgggtcataggagagtaagtgacttagttgttggggcatcagaatggttattaatgatcacccccttctgatgtctatatcatcagtgtattatctttgtgtatacatgaggtttatgtacatgcaaaagtcacccacatacgtgggagcaataatgaaatccacataaaaaattagactcaatcaacggtctttagctgcactttccccgtggtttcacatgagaccccgtctacacgtataaggaatcaggatagccattgcgtccaaatctagttccagatccgatttaatcgatagaagtgctggctcagtctttacccaaatgtggggttttcagttttgcctgctttatttttaacactgttattatagtcaataaatgaaaatgaaatctttggaagcaataaaggctttcatgtctatttcgatccttcctggatgaggaagcttaacattaaagcttatctgactacgtcttccattcatagcctaccctcatatctcctatgttctttattgtggttggcatgtggactaacgcttagaagtgccaaaccatttatgcctctagttttcacaatcaccaagggctctgtgtaaacccaattagaagccctgagagaaagagaatgaataaaactcagggcaaagattcaatatcatggaccccaactgagtgattggatggcaactgatatgtgtactcaacgtctgccaatcacaggataaaatgtttctaaatggtaaatattgttactttaaagagtgattcttaaaccttatggatggagctgaagaccattattctcagtaaactaacaaaggaacagaaaaccaaataccccatgttctcactttcaagggagagctaaaggatgagaacacatagacatatagaagggagcaacacacactggggcctaatggagggtggaggataggaggagggagaggatcaggaaaaacaaataatgggtactgggcttaatacctgggtgatgaaataatctgtacaacaaacccccatgacacaagtttacctatatagcaaacccgtacatgtacccatgaacttccaacaaaagttttttaaaaagaattatatggctgggtgtggtggctcacagctctaatcccagcactttgggaagccgaggtgggtggatcacctgaggtcaggagttcaagaccagcctggccaacatggcaaaacccagtctctactacaaatacaaaaattagccaggcgtggtggtgggtgcctgtaatcccagctactcgggaggctaaggcaggaaaattgcttgaacccaggaagcagaggttacagtaagccgagatctcaccactgcattccagcctgggctacaagagcaaaactctaacaacaacaacaaccaaaaaaaaaaaacaaacaaacaaaaaacctaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcaatctactcatctgacaaagggctaatatccagaatctacaatgaactcaaacaaatttacaagaaaaaaacaaacaaccccatcaaaaagtgggtgaagcatatgaacagacacttctcaaaagaagacatttatgcagtcaaaagatacatgaaaaaatgctcatcatcactggccatcagagaaatgcaaatcaaaaccacaatgagataccatctcacaccagttagaatggcaatcattaaaaagtcaggaaacaacaggtgctgcagaggatgtggagaaataggaacacttacactgttggtgggactgtaaactagttcaaccattgtggaagtcagtgtggcgattcctcagggatctagaactagaaataccatttgagccagccatcccattactgggtatatacccaaaggattataaatcatgctgccataaagacacatgcacacgtgtgtttattgcagcactattcacaatagcaaagacttggaaccaacctaaatgtccaacaatgatagactggattaagaaaatgtggcacatatacaacatggaatactatgcagccataaaaaatgatgaattcatatcctttgtagggacatggatgaagctggaaaccatcattctcagcaaactatcgcaaggacaaaaaaccaaacaccacatgttcttactcataggtgggaattgaacaatgagatcacatggacacaggaaggggaacatcacactctggggactgttgtggggtggggggaggggggagggatagcattaggagatatacctaatgttaaatgacgagttaatgggtacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagataaaaagtataagtttcaataaaaaaaacccttaatgtgtattagaatcacccagaaaggatgtagaaatgccccacaggaggtgaaaattaggtgtctgtattttcttgccaagtgattctattggatgcaaaatgtcaaaagcatctccataggcaagggcaatagagcaggagtgtttaatcatttttatatcccaccacctggagtttaaaagctgctcagttgttctttgttgaatcgatgactagaagggagaatgaatgaatgaacaaatgggtgaatacatgggaagggggttgtcaatggcacccagttcttcctaacttgattagaaagttagtaatttacagactagcccagctcatccccaactgtgatttctgcctttgaagtctcaatttgattaaaacacgtttagcaaggaacaataactttctgaaattctggagattatgcagctccaagaagctctgtggggaacaagcaattccagcaaccaagacaggtctttgtgaacctggagaggctgctttgcaagcctgtatcgaggccaaacatctgacttctcttaattacattctgtccttgtttcattccttctcatctcctgcttctgggtccttagttttccccaaactggcagggttgaatgatctcaaaaattaggctgggcctgctcccacggtgctggggcctgaggcatggacgagtctccttcaccatgaacaatggaaaaaaagtgtaggtcattttctctcccaccctaaacttctgtcgcaaagtgattttgcccagtaccttctgcagggtaatgatgctgtttcattagtaaaagaggaaggagcactgactctggggtgtgacctacctgtgtttaaatcacagccttgcccctttccagatgagaaaaccacctgtcttccaagatgtctatgagggtttatagcagctaaagaagtaacatcatgtaaagattaaagcaaagatcctggcgccctcctgcataggtaccaattgtaccaatctcagatctcccacttagctggataatcctggacaccttacttaactgacctgtgactcagtttcctcatatgtaaataggaatgaataattataactccatgccatttagtcattgtgaggggcaaatgaaattaatataaggaccaaactccgaccattttcttctcttgcccaaagccctatctaagggacctgaagagtcacatcctacagacaataaagtcttgtcagaggggttttattccatgctatataacatggcttagtttccaactttggcagaacatcacatgacagataaaggaggaagtcaaaatattttacctccaaatatgtttctttgccgtatttttaaatggcctgcaaagccattcttgttggggaaaaatgcatcttatatatatattctctattaacataacaagatctttccccattccaggccctcccaatcttgaagagactatctgagaatccagcatcttttagaggtctgaatagaaacactgaggcttcatgcacataagaaccctagtctccacaactccttctcttaacccagaaagtcctttctcttgattccaggcatttctataataatttaactctttcaaccaattgcaaatcagaaaatctttggactttgactctaccttttacttgtgccccaccctctaccccacttcgggttatcccgccctatcagactgcaccaatgcatgcctcacaggtattgattgatgtcttttgtctccctaaaacatgtaaaaccaggctgtagcccaaccaccttgggcacatgttcttgttctcaggacctcctggggggctgtgtcctgggtcatggccctcacatttggctcagaatagatttcttcgaatattttacagagtttggctctcttcatggataaatacatacaaggactgagatgattttgtgacatgtagttatccttctcgtgttacttattatgacaaatatctataacaatcatggtagctgttgaactacttccatgtggagaaatggaaaactgtcccatcctctcaaacgaggttttcagatgctctgcagttcctctcccctctatttttactttgcatttatctctttaattgggctgaggctgctggttgtaatgggtgttgctgagtcatctgaggacacagggacctatgtcaggaagaattgctggcagggaagccatcgaaagacagattagacatctccaaggcaggagtgagtcatctggtggtctgtgccttgtaccaacacaccggagccgaggagaagcacggatggctctgagacatcttcaatttcatctgcagcatggctaattctcagtttaataaaactagcctgctctgtggatgcacaggctaaacattgcctgaactatcacttagcaaacatttcttacctctcccactccttctttctttgcctctctctccctttactcctcccttttttctctctcttcctttctcttctctctccttactttttgactctattttttttctttttttttgggatggagtcttgctctgttgcccaggctggagtgcagtggtgtggatctcagctcactgccacctccacctcctgggttcaagtgattctcctgcctcagcctccagagtagctgggattataggtacctaccaccatgcctggctgatttgtgtatttttagtagaaatggggttttgccatgttggccaggctggtctcaaactcctaacctcgagtgattcacctaccttggcctcctaaagtgccgggattacaggcatgagccatcatgcctggccttcttttctcttctttatcctttattattaccacctccttctccttttttccccctctaatttctccctcatatatctctatccctttttccttccccacactatttgtctttctttcttcttgttctcatcttcatcttctcccttctcttaggagaactggacaaccaactttaagtcttcttttttttttttttttttctgagacagagtctcattttgttgcccaggctagagtgcagtggcgcgaactcgactcactgcaaactccgcctcctgggttcaagtaattctcctgcctcagcctcctgagtagctgggactacaggcacccaccaccacacctggctaatttttgtattttttagtagagaaggggtttcaccatattggccaggctggtctcgaactcctgacctcgtgatccaccctcctcggcctctcaaagtgctgggattacaggtgtgagccactgcacccagccttctctgcccttcttatctgtctccagacagtctagactaggtgccatcaaacttgttctgtaaaaggccagataataaacatactggcctttgcaggccttatggtttctgttgcaatgactaggctttacatgtgattgggtttcaataaaacttcattttcaaaaccaggcagtaaccgggatttgggtcatgggttttgataaatgctaagggaaatactattttttcttggtcgccctcttcatcataaaccagcagactaaagaacagatttcagcctcatggtactaatttctgggcccctgaaggtacagtccctctctcccaggttcttgattaaagagactgaatcccatattccagaaccctccctagatctggtggacatggaagaaccatgagttctgacttatgttgctgactattatgtgggaacgcctgaattcctgtctgagtttagagaatttggaaaacaaaccttggttgataagatatatgaaacatacatacacacacacacacacacacacacacacacacacacaaacacataaataaattaaggaggacgcttttgagtgtttaaattcttaggactgcagcagcaagtttagcaaagaacacagtaggagctcgatccagtttggcaaagggtctggctaagtcaaaactgtgcaattatcattcctggttgttggggttttagaattctctattcatgctaatgacattgcaatgaacaaaaccacatcagtgaagaacagcaaaagtcaagggtggagcaacgcagctttatttcacaagcccctccttggggaaggcattagagctacagtttggaagaggtttgcatggaagaaagggagaaactgtgaacagggctggtttgtcaaagaaagacataaaccagtggtgtgtgcctgggaacactatggatatgaaacttgtctactgttctcccattagcatgcagtcttgcctgaaataaacaaagcacatgttttggagtccacattgtttctcctgtcttgcctctactgtgctgcagggaaggagggtgcctgggagacagcaaggctcattctactggaggcttttatgatttggatggggctgctgaccaatatgcctggagataccccaactgtcctctacgaccattacttctactgcagaggtcaagtctttcccaaagaaacagaacaaaggaccatcactggttttgtgttccctttgttttgtttttaatatataatttgtctaggaggcagagaacctgggtttgagccccaactctgcactccctcgctgtgcatctttaggtgaggtcatatcccctctgtggcttcagtttccatattactggactaagtagcaatttatgatccactacagttgtaaaagccagggaatatataattctgttggttatatgcctcatattgcacatattaaatatgtgcatatatgtgcctcatatgcatattgcatatattgcattaaagagcataatacagggatatttgactattataatatacaaataagacaatggaggaatttgcctctatcttgtggtgaatacagaggtaagatgcctgggaagactgtcaaaagattggcagtgattcagtgattacctccttgcatctctctctctagaggtatctagtgtcctttctaaagaaaataaggtccctttcattaaagaaggtattaaatcgatgacataagacttgcaaaagtgtatctgcagtattttctaattcattcatttgttcattcattaaacaaattttgtttatgccaagctccactgagtcctgcagtaagggaacagcaacaggggtggacatggatagcgtatgccctcgaggaatctataatgcagtgcactcaagtggcccagggcacatggagaggccaacaatggcatctaatgtgtgccaggcatggactagcttctttatgtttattttcatatttaatccttaaagaattctgattttaaaatgagaaaaatgagactctaagaaattaatttgccccaggtcacaccactaggaaactgcagaaccttcatcttacttatttcacttctcttgctttgctaaatgccacaagtgtagagataagggagttcacaggcagggtatctagcttagaggtctttatgggagtattcacagaggagcgcagaggctgaaggatggatgagatgtcatatcaggaaatggggttaggaaaagagggaaggaggaattccatttttatagggtgttgcatgcagcaatccacacttatctaaaaaaaaaatttcaaatggtgaaattctggatgctgtagaaagttgaaagggaaaaatattcaggggtaaggggcattcaaggatttccccagtccacactgtcataccattcctaagccagccctaagaagactggctgtgaaggcctctcagggatacgccgtcctcagaatggacacatgtgtggtcatcactgcctgagctgtgggactgtccagctctaccccagactcggatgtcagcccaaagatattaagctgggaagttgatcaagggcagtgttgaggatattagcaacccatccagcggcccagagcaatttatgagaattctaattagatacaaggacttctgtgaccacacaaacactttctattctgcctgccagcacggggtcccctgccgtcaaaagctatcttgtatgcttcagtggaagatacaaggccaacaaaaaaaggactcaggatgccaacactgacccactcagagggagaaagtgagttctccattgacttccaaggctcccccactccaagatctgtgagcatcattatgctgaatggtgctattaaaactctagagtccattgcaggaagtttccttattaacatgagagcagggtttgtggtcctctccaatctgttaacaatctagatgagtctttaaaattattgctggcaaaagttgcagtacaaaaggaacagagggaacctgatgaagtaaaattgtgtgtgtgtgtgtgtgtgtgtgtgtgtatctttcaaatatttaacatatgattatatgtacaaatatgatataactggggtcactcactagttttaaaacttggacagtccaggcaacattggttgagttggtcactctattaatgtaattattttttggagacaaggtctcactctgccacccaggctgcagtgcagtgacatgatcatggctcactgcagcctcaaactcctgagctcaagcaatcctcctgcctcagcctcctgagtaggtgggcctacaagcatgtaccaccatgcccagtaatttaaaaaatttttttgtagagatgggtttttgctatgttgcctgggctgatcttgacctcctggattcaagcaaacctcccacctcaggctcctgagtagttaagattacaggcatgagccactgcacctagcctaatataatatcaatgcgagagatatgtgtaccatatctttcaaatacttcacatatctattatatatacctaaatatgatataggtgcaattgaatatgccatatacataatttttaacatacatgataaatatatacatttaattttatgtgttaaatgacctcagactagatgtcagggatgagtaatgtctattggagtttaaaaataaatccacaaccattaaaactgagcaaaatacaaagaagaagattaaacgcttctcaatactaaaaagtattacttatagctaagctgacctggccgcctgcaaaccaggtttctccttgcagcttggtttagtaggaaatgatcagaattggactcagatgaactagagccaattgttacctctataaaagtctgaacagggtgttgtccattggctggtagcctcagcatcacctggcagcttgttagaaatgctgggtctcaggctccaccctagacccactgaaacagtctttgttttaggaagatcctcacgtgattcttgctcatggtaaagctgaatgagctctgctgcagttcactttactcattggagcctcattttcctgctttgtgcaagggagataataagatttactccagaatattatataaaggcttactaggatattatatgtgatgtgcttggcatagtgctgaaccatagatgagaggacctaaaacaattttttccttcccttttctcagcatcacttgtgactgaataataaaattaggcattcttgttcttctcagtatcttttgttctggcccccagatatgagaagggtttgacctttatggtctttcttctgcttcttcaaaccccacaatcatttttttgaaaatcacaaaatgcatgagatagatgggacttatgggatcccctgttcacctttacttcaaagccagaaatgccattctttaagtccaaggcttacccagtcttcaggttctcactcaagtgttaccttttagggaccaagcagaatcgaggtactcaataaagagttgctggttgctggatgaataaatggctgagtcttctgtgaaccctggcccattctattctttgtctaaatcttgccacacgtgttttctttatgaatcattctgtcctttattcttaaagatactagttatgtctcgtatttctccttgaccattctcttatctacccaacacacctaagaatatatatgtatgtatatatatacacatacataagaatatataccacatacataacacatgtgtatatgtatgtctacatatgtgtatatatacacgtgtgatataaatttatatatgtgaattactagaaacgtttcgattttaggattagatattttgcatttatacatttgtcagcctactggactgtaagttcattgagggtaagaagaaaaagaccatgataaccccttctgggaatatcagtgcctacgaaaacatctgtttctcagtaaatgttgggtatcgatgctgagcaatgctgaaacatatgcatgagcattgttactccagtactgagagccaaagatgccatggtgcactctatcattttagaaagaccacagacaattagatggaaaaggaaggcaacatcttgctaggatcttgtgtatgcttccaggcagatgaacagcctttttcctagggaaatgcatggcaggcttcatgtaagaggttccctcaataaccaaacactccattcaaaggttatatttacacagctcattaggaaaattttttatacttttgacactcattagactcataatcgtccactgaagctactgtgtaacaagagataaacactccattctagaggatgaataattaggtactgctcagcactgtgctctttacacgtctaattttagagcataattaatcctgctgaagctgcatacgataagtgaaatatttatgcagctgtgttaattcatgtatttactcctagagagacattcagaattggtcatggctttccgggaagatcatctggagacaccccctggaccaatggcattttctctcccaagtcttatgcctcccgatggcctcaagagatgaagctgaatagagacatttcccaaacccaagtctgaccaggaaggcaatgagccagaacagaaaatatcgatgagaacctagatgttctgtaagtacatgaacaaacccctggcccatctggatgcttttactgtttattttttatttggtgcaaagaagaccttttctgtttagcaccacaaaagttgtttctgtgttactaacttgactacattattgccagtgcaacactaaagaagttgtgtttgatactagagttgtgcacgggcaactatggtgatgatgagaaggagaaggatgaagaggaggaggagggtggtggtgatggccatgatgatggtggtgatgatcgtggtaatgaggatgatggcaatggtcatgatgatgatgatgatgacggtgatggtggtggtgatgataatgataataatgatatcagaggcgtgtgaaccagaacactccatcttaaatagtagctgggtaaaatgaggctgagacctactgggctgcattcgtaaatggcttaaggcattctaagtcacaagatgagataggaggtgggcaaaagatatagatcataaagaccatgctgagagacaaaacaggttgcagtaaagaagctggccaaaacccaacaaaaccaagatggccatgagagggatctctggtcgtccccactgctacactcccaccagcgccatgacagtttacaaatgccatggcaacatcaggaagttaccctatatggtctaaaaaagggaggcatgaataatccaccccgtgtttagcatatcatcaagaaataacccagccttgggtctgctctgtctatggagtagccattcttttattccttaactttcttaataaacttgctttgactttactccatggacttgccctgaattctttcttgcatgagatccaagaaccctctcttgaggtctgcattgggaccccttttctgtaactacaatggtgatggctaacatttattgaaccacttgtatgttacagggtctatgctaagctaagctatgcactttacatgtattctcccatttcatcttcacaccagccttattaggtaattatttctgtaccctttcacagatgaataaaccgaggctaaaaaagatcacttctttcatagaagtatttgtaaatgggacagtagatttagttcagatgtgcactaaattactccttcctaaaggatttatacatctcaagagtttagtcatctttgatagataacttagagaattaaatataacaacagtcttccctaattggcccccttccagagtaaggtccctgaagtagaagctttgccacttactagctaggggatttgccctctgagattcaatttcctcctctgtaaagtgggaataagcaacatttaacctcataaggttacgaagattacattgaggaacgtatgtaatgcatccagtatgatgattgacatacccaagtccctaaatatgttagctgttttataatagatgcttcgagagtgacaccaatggtgggtggggctagagttagaactcacttatttgacagatacctatcacatttaaaagtttccagccaaatgaaatacatcttaacatcaatcaatcattcatccatacatgtatttattcattcaaacctttattgaccaatttacctgtgatgttcagtgttttgttgtaatgctggaaataagactcctgtttgctgaatagttcatcccctgtaagggtgattatccacccctgtgataggcaaaacatttggccccaattcttcagcatactctcagtgtccacactattgccataaaacttcaagacctatctcatgaaaggcagagtatacctgcaatcccttgaccctgaacttggccacctgacctgctttggacagaaggatgttagcagacgtgaacgtgaccaagcagtggcttgaaatgtgcatgtgcagctaggcgttcctttctgtgcttctgccatggccaggaaaagagcttccccaggtagctgctaccttttcagcccgagacacagcagaaacacgtgtggagcagagaccacaccactgattcgtacgcttgtggcaggaagcagaggcactatccccaccccaggcagagcttctccactcaacctgcactaccatgaggaaaataaatgcttactgttgtacgcctctaagatctcacagcaaaaagctgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacacgttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacacagctggcccaagcggctttacagttctataaatgccacagtctcattagactgcaatagagattgcctttccttcattcctccacgggataagaacatgagttgccatgttggtacaacatgactccaccgtgagtcatgcctgataagtctaggaaagagtctttgacctcaaaatgcatcagaaatcctttctctggagtgaaattgggactgattacagcctagttatgtaattttgtacagcagcgtttctcaaccacagcctaccaacatgtgaggttggataattttgtgttttgtgatgtagggggctgtcctggaccctgtaaggtgttttcctgcatcttctggccctggcctctacccattagatcagcaagcagattcccagccgtgatcactgaatgtgtctccaggcattgccaaatgtcacctgagggacaaaattgcccttcaccctttgagaaccactgccctagacagaagacctataaattcccacttaaggcaccaggactgtcctggctcttgtctttttctaaacctatttaactctttcctaaatcccctgagagagactgtatccttagaatacttttgtttgttaaatttagttatctagaattgctttccattataagcaacctaaagaaccatggtttcatgtgacaggaactcagtaaatatttttagggagcaaactcatcatgcaaagatccactgggaagcccaggagcaaacaaagcgagtgtgagggtctcaagtccccctaaagaaaggggtcacccggggtcttaccatcacccacaaactgaagcaaggccaggtcgatctgcctcttccaaggagagcctttctgaagggcaattccataaccggtggtggcaaagatgtacccactcccgatggtcaccagcttgcagccttcatccctcccagccttgtaattcaagactgcggcatcgtagatgaaagcgtccagcttcctgaaatgacaagaaaccagggggtcataggggtggccaggtaccacctcggggtccagctcctgaggcctgatcctgaaagcatcccacactttctttcatgctggtgatgatgactcatggcctctccatcccctcatcataaaaggatctatttttaatgaggagataaaagccagaaccttttctctccaacttacaagaggcagctaaataaagacatgaaggatccatatacccaagtgagtaaacagttgagtttgctggtttgctaagtgtttgtccttaacactcccagtggtggaggacagtgccctatttagaaaggtttgcatcagaacaaaataaaccactaaggggcagaagaatttggtggtagtgtgtatgaaggggaaaggaactaaataggaatattttttcctcccaaaagaaatacatgtgctgcttatttatcatacagaaattattgcagaatttttaaaaatccaaataatatagaaaagtattaaaaatacaattaaaattaaagctacctataattctataactcagattcaacctttgttaacatgttagtgaacagccttccaaatgttttagtgagtatgcacaaacacgcatacacagagattggcaaactttcttctataaagacaagataataaatagttgaggctttgtaggacataccgtctctgttgcagctattaaactctgctgttgtagggtgttatggggctgcactgtgtccacccctaacattcatacagaagtagggtgaacccctaatccactgtggctgccgtccttattaaaaggagaaatctgaacacagacatgcacacagggagaacgccatatgaagactggagttatgctgctgcaagccaaggaactaccagaagtcaggagagaggcctggaacagatccctccctggagccttcggtggaagcgtggtcctgcagatgccctgatcttggacatctagcctccagagctgcgagacagtcatttctgttctttaagctgctcaggttgcattcctttgttatggctgccctaggaaaccaagacatagtgccaaagcagccatagagaatgtgtaaacaaacgaactttgctgtgttccgataaaatgttatttaggaaaacagatgggtccacgggctgtagtttgccaacccttgttttaatcccgaaaatgttattatgccacacaaactatttcacatattgctttcttctctcattccatacctagtgaatatatttccatgtgaatacacatagcacttttaaattcttttttgatacacttatttttattgaggtataacgtatgtgtaataaaatgcttgatgaatttttacatatgtatatatccttgaaatcaccatgcagttcaaaatgtggaatgttatcatttccttagaaatcctatgcataccccagaaaataagcatcaggtaatctctccaagggcacaactgtgcctaaatattattattattattattattattattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatccctgtcagtagtcctggatattgtttccaaatgttaaagttatttaacgaggctgaaatgatcactgtggaatgcagggatgaatgtctcaactctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacagccgtgttcttcattttaatttttttttgtttctataatggtttgaggtggcgcaaaactgtaggacttgtctcatccacagaaacactctgaagctttgatctcaaggtaggggtatcagagacttggttttaggctctgagagtattaaagggaatcagatcaagcagcagcagaagagaactgggcactgattggcaacagcgatggtaacctagagctgtcatacgtaacctggagcaacctagagcttggcttgatgacagcaagtcaagaggaacagccagcaatagtgagacctgcagaaatatgggatggagagttatacaaggtcaaaagtaacttgtgtataatgggagtagggtgtgtaacaggaacactggagtagtaggtgaaaggaacctgagttctagtctaggctaggatgatggtgcaacctcaggaaagtcactttctccttttggatttctggtttctcctctgtgagaggtggcgttcattgtggtcttgctgagacacttgttcagctgtggtattctaagattgtgtgagccaacagtcacattctgtggctatccatagggaaattgaaactctggataacacatgtatcctaaggacttagggccgtggaaggtgttggtctcttgataaagctgagatacttgcaacgtcaatacttcccgtatccatgttgccatggagatatagaaacttggttttatttagactttctaagtaccacccaactctcgtctctccattcctcaaaaaataaacatatacacacacacatgtacacatgggcacattcaaacattagggccctctgttggaattcatggggtgaaaccttctcctatcctgctaagccactgtgcactgaggtgctgctaggctggaaatctacacacgtacctagcaaccacataagagttgtccagaagcagtttaagttggtattttatggacaggcatagacatcttcaaatcagtaccatatttcatgacaggtctttttgagctgagcaacagacagacatatgagtacaaggaataaaggaagttttctttgggaacaaagtttataaaagcacaatgctgaaaagtcagaggcaggacagctgcaaaagatgtggttgactctgaccaaagcagttacacattggcatgactggggtgggctggtggtcatgctgtcagaggggtctggccatggaggcacacaattgggccagccctccatggcctgactgtcatcttagggccatgtcagaactgaagtgattacaacacagaaaggaaactgtagggccacatgaactggtttctagattctagagagctggggcctacacacaatgggctacagacaactgcgtgtttaaaaatatcctggggcatacacagtcccctcccagagagatggtcattgtctgagataccatctcacaccagtcagaaagggctattattaaaaagtcaaaaaataacagatgctggcaaggttgtgaagaaaaagaaaagattatacactgatggtgggagtgtagattagtgcaaccattgtggaaagcagtgtggcgattcctcaaagacctatactgggtatacacccaaaggaatgtaaatcattctattataaacacacaggcacacatatgttcactgcagcactattcacaatagcaaagacatggcatcaacctcaatcaaacccaccagtgacagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttaaaaaaagagatggccattgtctgcaagatgttttataaaataatacttagcatttcacagacatcatcccactgaggcctcacaactgtccagtagcaagatattattattgttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatatgtttagtgcaaatgagttgtaaatttcatttaatttcattaatttagattgtaatgtagggggtcccacgtgcctatgggctattgcggcacagccctagctgttctgtggcaagcaaggggaaggcttagggagcaggactctgggtctccctttttgctctgacccaaaaagtctacttttgatccgttttctattggaaaaaataattgttcctgttgttaaaaagaaaaaaaaatcccctaaatctctgagatttgtcaacagggactttgggcaaagcaactgcatttctcaggctcagttttccctatgaaaaatggagccaacttgccgggcacagtggctagcgcctaaagtcccagcactttgggaggccgaggtgggcggatcacctgaggtcgggagtttgagaccagcttgaccaacatggagaaaccccgtctctactaaaattacaaaaaaaatagctgggcatggtggcacatgcctataattccagctactcgggaggctgaggcaggcgaatctattgaacccgggaggcagaagttgcagtgagccgagattgcaccactgcactgctgcactccagcctgggcaacaagagcaaaactccatctcaaaaaaaaaaacaagaaagaaaaatggagccaacaatatttgcccttagagggctgctgggaataaagtgttattatataagtaaagtatgtgtgcaatgctcagaacataacaaatgctcgaaacacataaatgcattcaatcaaattcagattttatgccaaaggggctcaccaattttatggatcctataggagaaatccagttctgcatactttatatgcattattatattttttggtccttctccttgtgcagggatgggcatactactgccatccccattgtcagatggagaaactgaggcattgagcagtaaagtgactcagcactaccacccagcccatacgtgtcaaaagtggcattggaacctatgcagtctgacaccaaagaccactgacataaccactgtgaccaagccatgctatccataagacttgtagagtaaatggaggcagctctattacttagaaaattcagatggggggttttagctataaataagccaaatgttttgacagaagaggcaaggatggggccagagcggccggagtttcaatagtcgtggtgggttgttccacttcatctgtctcgttcccaacagccacagagtcatctaaggggctgcagttacctccatagaaaactcttgcccctaacatagtctactccagtccatcggaagacatgtaggtataggtggccatagcttcttgttgaagatggagggtaagaaagagaaaaaaggccacctgaaacggaagcccgccatatttcaagtgcttaatttccatagtagacagtgtcagagtattggtctgatgtggaccaatggcatttggaggggttgagctgcgactgctggactcagagtgacgtgttaggctgcagcctggtatgggcagcactggcttggaacaccactgaggggctggttccttagaaccaagagcatccaactgaaagcccagttaagaacacacagctaagggaacccatttactcttctctgcttggtgcatgttctcttccttttttgaagaggaatttgtctttgtgccacattctcagttcctacccaggtaccagggttgtgtttctcccactgggcaggaggacgttcagaggtcaggtctgagaactgtgggatgttgcctgtgatgaggacagagacaccatctgacacactggggtccatgccacctttctgcctccactccctatagaagatgttggagaggagcgatccctcttctccaatgtctgcgacagaccaaagacaccttggcttcacaccatgagggctggagcagtgctggagctcaaaagaatgccatgctatgctggctacatgacaggctcaccccctgccaggcatcttagtggctgtgcgggtgccattaccttctccatcaccggcagtcctcaaggagcacaaatgattagaaatgacagtaattcagaacaagagggggaaataagacctcctctctgtaaattagcaaagaagcaaggtaaggacggatgtcacatgtgccccatgctactttaacctagtggtttcctgccatccttattgacagctctcaagagctgctacagctttcacaagtgtgtagatctgaccccattcctttagtcagtgggtctctcttatacctgcacaatggccttgaaagtccaatcctagccccaagactgtttactggcaaatctaattgtccctaccctggggaggactataccccacagtagaggcatggacacattagggatgggaacttgtattatcaagcggcttgacatttcctaatcaaaagtttccggttttagctcatcatcttcttatgcatgtttgcagatgctctctgggggtctcagcacatttaaaggctaattatatagttaaagttaattattcattcattaacattcaagaagcctttaacaagacactgcttgtcttgatgaattaatgaaaccagcatgtgcacatgagtgtgtgtgtgtgttactgaaaattaaaacatctctttgatgataactgaatatatttttttcagatcaaaccaaacccttgccaggaagaggaacacattagcacttgaggtcagttggcatgtttgggcaactgtggaacagggaacacaattcagatttatcttcaccagctccatgagtgaagcccggtcatgggacctctctgagcttcagtattctcatctgtaagatgggaaataaataataacttattacagggctggctgttggatggattaaaatggaagtgaaggtgttttgcttgtaattgcagatgctggtgggatttaggagattatctggcagtggtggtatcattatgcagagaagcagtggaggtgtggatcaccaccgggtacccatcggggaagggcattcatgatccccagaaatggcaccactgaggcatgacaagctttgaaattgtttacttgggcaagagacactcaacctatacagggactacctgccatcagcacagaatggtctaaaactggctttgggaaaatggcctagaatcacattttgattctgggtttgtgaatacaaactctaaagtcagagttataccaacattgatgaattttcacaaaggaagcatttttcaaagcaaactcccttaagctaatttaattcctcgatcgatgtcttgcatagcgtagttaaattgtttccaacttttttggaaacatttttactggggtcaattcttttgtgtttaaattttataaatatttgcttcattgatcaggatttggaccacaacaaattttactaatttataacttctgccattttgagttttcttttgtggttattatttccaccaagtcaagtccatttctcctgggtcaaaattgtacagagatccaaaattagctaagaagatttgagtcatctatggatttttagtcaataccaaatttcaccctgtgtgctttcagctcttgtcagtttattttgtgtggcttattttttttaccaataatattcactgtgaattgggcaaaaaagatggatggttaatatttatttttttagctgataataaatcctgagtgattttgtaagacagaggcagagagaagcagagaaggggagaggatagaagagaggaagagaactagggaggaggaagagatccagatggaaggaggtaccaagcaaaacatgaagacggagacagaaagagagaaaaacgatgagaaagagaaagtgaggaagagaaacagagaaggagaaagagatgttagtaaggtacagagagggagagaataaaaagtgagatatattgcaagaaactaagagaaaaaaggggggaaagaaagagagaaaaagaggatagaagaaggtaacggggaaggagtgaggacagtgatatggtttgtctgtgtgcccacccaaatctcatcttgaattgtagctctcataattcccacctgttgtgggagggacccagtgggggataaatgaatcatggggccagtttcccccataaggttcttgtggtagtgaataagtctcatgagatatgattgttttagaagagttttcctcttttacttggttctcattctctcttgcctgccaccatgtaagacatgcctttcaccttccaccatgattgtgaggcctccccagccacatggaactttgagtccattaaacatctttttccttataaattatccagtatcgggtatgtctttatcagcagtgtgaaaatgaactaacagagagagagagggagatggagagggagagggggaaaaagtggggggagagagggagggaggggagagagggagggaggggggagggggagggggagagggagggagagggggagggagagggggaaaaagtggggggagagagggaggaagggtggagggggagagggagggagagggggagggagagggggagggagagagggagggagggagggagagaaaggagagacagagagaaagagagacagagacagagagagagagaaagagaaagaatacccaagagatgaatgtacccactttgtctattgactgctaatttcaaagatagggaaggattgaaatgattgtccaagtccatctagctgtaagtactttgtttctgttaaatgtaacgttggacccaaactgactatacccaaggagttgagacagtatgtaatccagtctcttcatttttcagatgaggacactgaggcccagagatctccgcccaatttttccagaccggtctgtcactcaccaaagcagtgtgccttcaggacaccattgccgggctcccccagtgcaaggcctcagctgggatgcagggtcagagaactggctctgcatactttgtggaaagttgggaaagtctaaatatttctctaagccttgatttccccatctgacaggaaggaaaacataatctgtctcctatgtttatgcactggttgaatgaagtcccagccatgaatttgtttggtgaattgcaaagcactatgcgatgctgtattttcttcaccacaactcatgctctgacataggaacagtattggttctttctggaatgctactctttatagagcttcttagattgtacttttcaagggttgaggtcagacctaaccattctgctgcagatttcacgaagcatagcgtttttataatattagaaagatggctcaaaaaggttttctttgttcagacttttcttgaacatttactatgtgctggacactgcactctttgccggaatatctcatttaatctttacagtgcatttccaagtgaaggcagcacaattagtataattttataaaagtggaatactggagtctaagatgttaataacttgtccaaggtcccaacactggatgtcactggagtgggaattcgaatccaggatgcttatcctttaagcaccccatcatactgttagtagtgacgacatcacggaacttgtcacacaggaggactgaaagacagggactctcaggggccagaaaacatgagagtgaaagagagattccgaaaaacatcgagatttgtgaaaatgctattatgtgttagatagaatgcagggtactttccataagtcaacttggttatttctcagaggaattccaggaaataggattttacacatgtgggaaacaggctgagagaggttatttaatttgccaaaggtcacacagctggtattagagacagaatattaaagtaggcgtttcttaccccaaaatccactctctgcaccaagaggccactcagaaaatataaaaataagcaaatcaaataaattgactacgtaagtttgaaggcttcaagaaaatataaatacttccacccagaaattctatgtcctggtttcattcctagaaaaccacttgtagaggtacacagaggactccccaacgatccttaacacagccatatgactgatagccctcatcccacccccccaaaaaaagtctagtgagaagaaaatgcttaaaaatattctgatgcatgcatatcatggagttctttccagcagtcaaagagaatgaaggcaaaaaatggaaagctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgagatcagcctgggcaacatggtgaaaccccatctctattaaaaatacaaaaatcagctgggcgtcatggcgcacccctgtagtagcctgtaaacccagctactctggtggctgaggcaggagaatcacttgaacctgggaggcagaggttgcagtgagccaagatcgtaccactgcactccagcctgggcaacagagcaagactctgtctcagaaaaacaaaaacatatgcaaatgcatataataaaagtcttggagaaatggaacgtacatcaaacagacaacagattggcattgagatgccaagccaaaggaatgcttatctgtattttcatttttttttttttacaatgaggatacattttttaatgagaagcaatatagcataatggttaagggcatagctcctagagccagttcaaatcccagctctgaagcttaccagcactgtgcctgcgtcatgacttaagctgtctgtatagtggagatgctgggcatgccaacctcccagagaagctgtgaagattaaactaagagttacaggtaatacactcataaaagctgctggggccgggtgtggtggctcatgccagtaatcccaacactttgggaggctgaggagggtggatcccctgaggtcgggagttcgagaccagtctggccaagatggtgaagccccatctctactaaaagtacaaaaattagctgggcatggtggcacacacctgtaatcccagctactctggaggctgaggcaggagaatcacttgatcctaggaggtagaggttgcagtgggccgagatcgcgccgttgcactccagcctgggtgaatgagccagactctgtctcaaaaagaaaaacttcctggcatggagtgagggctacctaaacaactgagaccaggaggcaggggatagggaaggtatgggaaattggccagcacaattaccacctgatggtgggagttcacacgcaagaatccactttgcatacctgtgtgctgtgcattcctgtggaatacaccaccactccccacagcacacccagataaagtactgggcagcatggcctcttcccctggtccccaagacacctgaggacagcctccactggcagcactgatgtcggatacctatcaggaggtgatgttgggaaaaccacactacagcctaggtgagtatacctccaaattcatgtacacctgggacatcagagtatgcccttatttgaaaatcatgtctttgcagatataattgtttaaggatcttgagataaagtcatcctggatttagggtgggtcctaactccaacggctggagtccttagaagaagaggagacataccaagggaagaaggtcacctggagatggaggcagagattggagagatgcagccacaagccaagaaacacctggaggcaccagaaactggaggacgcaaagaatggccctcgcttagagccttcagagggagcaaggccctgctaacaccttgattttggactctggcccccagaactgagaataaaattctgttgttgcaacccaccatgcttgttattggttatggccactctaggaaactacttcactggggacacctgaaggtgcagtacctgagttcctatcactcctccacctgcatttctctatgggaggaaggaggtggggcttgctttgggagaggcagctgtctggggttggccccgggcactttccatggggtgtaaacagtgtctcctaacctgtgttagaggctttccatggtctgagtgagcccagtgccaggaaaactcacttctccctgcagcaagagaacacacagggctgatacattaacaccatgacctttttagcacctgggtcagtggagatgtgtttataattttactgtggggagaaaggaagctgagctattccaaacctgtgatgcttcatgggtgagagcaacttcgcatctcctaaccccacgaccttgtaacagataggtacaacccttgccagagctgttcccttctcaggacaagcagagggttagcacaacatcatgggtcagaaaagatgttgggtcttcaactgaatgctggcactgctactcattagatgttaaccttcagacgaactgtggcttctgcctgaacttcagtgtcctcctctataaaatggagaaaatgattatctggcagagttgaatcaggaggaaatgaggtcacatgtttgaagttcccatgtgagttcagcaagcaataacaagaggtgggccaggtgtggtggctcatgcctgtaattccaacactttgggaggccgagacaggcggatcacttgaggtcaggagtttgagaccagcctggtacaacgtggcaaaaccctgtctctactaaaagtgcaaaaattagccagacatggtggtgcacatttgtggtcccagtactcgggatgctgaggcacgagaatcacttgaaccctgcagatggaggttgcagttagccaagatctcgtgactgcactctagccctggtgacagagtgaggctctgtctcaaaaaacaaacaaacaaaaacaaacaagaggtgatccctaaggatatagaacctgccagggagttcctgcttcttcacagttcttccccaggaggaattttctgaccatgtgcttcctgtggcttggctcgaatagaagaaattcatttcctccacgctcttgctccacacattcatttattttccttatctcaatggaagaagaaacattgccccttttgaaacagtagtaaagattttaaagaaaaaaggagaacttttgaagtaaaaatatgacgaaattggtactaggttttgcataatggtgggccattagaaacggccttaattgtggaatattatgagaacagtcatattttttattttttttacattgtgactcaaagcaggggctctggcgtaagattgatcccagacacgctgcttaatctctcaatgcctgtttcctcaaaggtggatgaaaatcttgatggtcaccgtcatataggtttgtcatgatgtttaaattagataatggaggcaaagcatttaacacagtacctggcactcaggtaagctcccaataaatggaatctgttagttagaaatgcctcacttaagccggtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccactacttgggaggctgcagcatgagaatcactcaaacctcggagatggaggttgcactgagctgagatagtaccgctgcactccagtctgggtgacagagcgagactctgtctcaaaacaaaaacaaaaaagaaagaaaaaagaaataaacaataaaataaataaaaacacacaataaaaaaatttaaaaaacaaagaattgctttgtgtccaaagcaattcaggtagctcacactcactgtaatagaatagaataaggtttacacatacggataaagcaattggagttaagtgaattcagaagtggaatagtagctcagtcttagggaaagtcagtaaacagattttcaggccaaaggctccacaattgtgaaagaagaatcatgcattaagctctgaattgtgcggtaatccaagcaaaaagaaaaccataagttgttataagaattgtgttgtcaacaagatcaaagcgtgcctcaaacagaacaaagcaatgctcttcatcgtacagaagtgtgagggatgctacaggacgacattctccacaagctgtcctgtaataaccgtatcagcaaccttttcaaaaataactatttcttgtagtacccttcagtgctagttaaggcatgatgaaaacacaaagcagtaaaagctaaattaattaatattcctctagctcaatgaaattatcacctggtccttaaatgtggaaactaaacaacagaactgtctactttaattgagaaaagcaaaacaaatttgcatatgcaccgactcaacttgtatgaattgtatatatgcgttgacaatacaagaatgaaatgcaggaaaaaatagagaattatagtcagaagaaacttttttctagctattgcaagtaatactgtgttgctgaaaatttgttaaatgtaaaaagatgtaaagtccatcatcccaatcacctagcagcatctccgataacattttgatatatttctttttagtctgttttttttgccttttttttttttccgtctctgagtttaaagaattatgatctcactttatttaactcctgccccccacagacatttttttctactttaaaaaaagtttttataggtggccttgaaaatcctttaacgttgttttaatagagcttaccaggaaataattccaagaaccccacccccccgcaaaaaaaaaaaagatgtctgtgtttacttgagtttttattaaggaaaaaactttctaactctatgatgtggaagcaattatttttgagctttgtttgcagtgtgggggtggatctcagaaaccaggtcattgttgatctgattttctctggagatgacgctaccccatttagaacagctcactgaaccctgatgtctatgcccgctttcgaattcagcagctggaaatgaaccatttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttgagcatagaaatgataatgctgtgattttatcagttctcagatcatcaattaatatgatatgtactctataatatatgcacatatgtaatatctaactttagttttaaattctcccctgaaccataaccccgtatttccaactgcctaggtggcatttccaagtggggaagtaagcctaacttctatacttactaattctgcaatgtagttacttagctgaatagcctattgggtaattaggttaacattgttgagcttcacattcttcatctcttaaaagggatattaatggtacccagatcgtaggggtgttgtgaggattaattgagattaggcatatgaagtgctcaggtctgtagctcactaattgtcaggtcacattaagtgcaaagatgcctggacatatgatgatggtgttccaaaggcacttccaacttaatatgcctaaacctaaactcacattttgccacatctccacccatcctgcaccctccttctgaaatatcctccctcttccttgtcctgtttagtcactacagaactccatttctcaatagtcaactaactaacctctcaaagacatggactacctacatctgaatcactagaagcactaataaaaatgtaccttcttggccgggtgcggtggctcaggcctgtagtcccagcaatttgggaggccaaggcaggtggatcacctgatgtcgggaatttgagtccagcctgaccaacatggagaaaccccatctctactaaaaaatacaaaattgacagggcatggtgttgcatacctgtaatcccagctactcgggaaggctgaggcaggagaatcgcttgaacccggaaggcagaggttgtggtgagccgagattgtgccattgcactccagcccgggcaacaagagcgaaactccgtttcaaaaaaaaaaaaaaaaaaaggtacattcctaaatcccacaggctttgcaaacctgtgctctaggataggaattcagtgctcatttgtttttcaatgcaaaactttctatgaagacatttcaaacacatacacggagatgggactacactgttcttttgtttttacagacatgtcactgaggacaactcaagccttttagaaaaatatttattggtaaaaagacaatactccctaaatttttttttaaatgtgcatcaaaagacactatcaatgtaatagctagaatataaaaaggtaacccatggaataggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctcgataccactaatcattagggaaatgcaaatcaaaactgcaatgagataccacctcatacccagtgggatggctactattagaaaaacagaaaacaacaagtattggcaaggatgtggagaaattggaacccttgtgcactgttggtgggaatgcaaatgggactgtggaaaacagtatggttgtttctcaataactaaaaatagaattgacatatgatccaattatttcacttctgcatatataccaacaaaaaaaaccaaagtctcaaaaatatattcacacatctacgttcacagaagcatgattcaaaatagttaaaatgctgagacaactcaagtgtccattgaaagatgaatggatgagcaaaatgtggtacctgaatacgatgaaatactgtttagccttaaaaaggaataaaattttggcacatgccaaaacatggatgaacattatggtaagtgaaataagctagtcacaaaaagacaaataccgtatgattccacttagatgaggtacttagagcagtcaaaatcataaagacaaaaagtagaatggtggttgccaggcgctagggaaaagggggttgaggagtttttgtttagtggatagagagttgcagttttacaagataaagagctttggagacagatggtggtaatggttgtaccacacgatgaatgcatttaataccactgaactatacacttaaaaatgtgaagatggcaaattttactctatgcatattttatcacaataaaaaatactgggaaaaaagacaatcctctcttccaattcttctaactactgcatgtaaaggaaaccaacagagacctgttttttaacattgtgctgagaatgaaatcgcacaggggactggggatcctgagagctgaaaactgaggcttctaaggaaattgggacttttccataaatgtatacacccagacttgtacatgaaaatcaattaaaagaaaaacacaaactatcccactgtgtcttgaaatattaggctcttcggagttctagggacgttgtttaatttaaatctggcatatgtgcgacgcttgcagttttgcccccatgccaaaatggcttggaggacatcagcttctgatgactgagcatttgtaaatctaaatctgtctccactcatttcagcttcagctccctcttctagagtggatgttcttaaaatttgattagggcatatcggagtcacctgaagagcttgttaaaccatgcagatcttcagacccctccttacagagattctgattcaactggctcagtggggctcagcaatctacatttttattagcacctattctgattcagactcaggctatgcttgagaagcattagcctagaaacctggggtcactgacgctcatccacctttggttcacaggagtcccacaaggcacaacagatctgtgcctgaaaaatcccatctctgttgatgtttacacatcaaacccttttttctcactgatttgtctgataatttctttatctccatttattatgaatttcaataaacagtaaaacttagctttcaagtttttctctgcctatgcctttcttcaaaaaattagggattccaaagacaagcatttggcttgtctactctgtatatgcctatcccaataaaatgtgtttcttcaactcctttaaaatagtagttctcagctctgttgcacaatgaatagtgtgttggacttctaaaacagtagttctcaaatattcgtgtgtctcaaaatcacgtggtgtggcgtgctgcggggaatgatgcttattataataaagattcacaggctccatagctagagagaaagccttgtcctgggcccaggaatctgcattttgacaggtaatcatgtgattcaggtacagttggtccattggccaggcttggaggcacccaattttggggcatgattctaaatcctttctgcaaaactgacagttgtttgcatatgtggtttgtctgagtcttcctaagtgtttgacacagataaaagaatctcatgaactagtttagagatcaaagaattcaaccatttcacttcttagatggggaaactagaaagtgacttggagaggtgacatgacttgtcccaggacacagctagctaatgctcgagtccagactcaaacccagctgggactgtcacttgacagtaatccaaagcctgtctggtgttcaggactctcccagaaaattacaacccacaatttcactgaccctggtgtgcatgcacgtggctttgctaggcagcagatgttactgaaacgtgtgggtggagcagtgagacccagcagctgagccacatgctctggatgttctaagtcaaggcttgctggattctagggtgttgggggaatgttcaaaagctgagcaattcgggagcagatgaggttaccttcttcaaccttccagagggatggaaccttctacagatgctggtcgtggtaaaggacgagaatgactttttttttttaaggctcggtggtaggtacaagaagatttcattgtattattattattccttaaacagcaatatatttcataatgaaaattttaaaaaggaaacaggagatgtgaaaaggaaggaaaaggcctgtgagtgtggtgacgtggacacctgaaagaccgcagtctcgtggtgggacgttgagaagacacaatcaacacaaagttgatcggatcttggtgtagctctgtggtggtaattctcatattctggttttcataatcatctgaggagttgaagtcatgtctcataccacccaccaagaaaaattccaaatattaaaaaatgcaaccaaaaaagaagaaaacacgaggtaattatcttgtaataaagaatgatgaaagacttttgaattacgtctcaaaattcaacagccataagcaaatggttgatatatttcactacaaaaaagataaaatctgcatggaaaaaaaaaagcaagctcaaaagactaaaaaagaaatagggaaaatatttgtaatcacatcacaaaaggctcatctgtccaatatataaattaataagaaaaagaccaacaaaccaatagaaatattaataaaagtaaaaaaggaattgccgatggctcttaagtatataaatatggccaaaatttactgagaaaagtgcaaatttatatctcagcatactttttacctattagcaaaattttgaaagattaattacacattgtattggcaaaactttggagaaataagctctctcatgcactgatggggtaagtatgaatttcctttggagggagatttggcaatatctgttaaaattgcaactgtgacccactctttcaagaaatttattctacactgaatgtgacgcaatacaaagatattcactacagctttgtttgcaatagcaaaagattggaaacaacctaaatgtccaacaatagaggcctgaccaaataaaatatggtatatttgcataatgaaagattatgactctataaaaaataactttatggctttttatgcattaatatagaaagattcagaagaacatattggaaggatacacagagtaaatgtggttaccatggaggggtactagatgaggaatagtgtgcagggaaaacttttcactgtttttttctttttatgtacttttttatttttgacgtatataaatatcttatctattcaaaatttaatttaggctgggcatagtgactcactcctgtaatcccagcactttgagaggctgaggcaggagaatggcttgagccttctgaatttgaaatcagcctgggtaacacggcaaaacctcatctccacacgaaacacaaacattagccaggtgtggtggtgcttgcctgtagtcccagctactcaggaggctgaggtgggatgattacctgagcccagggaagtccaggctgcaataagctatgattacactactgtactccaacctgggtgacagagtgagaccctgtctgaaaaaaaaaaaaaaatttaaataattaatcaaggagcctgttaaacatgtatgtggtttccccaaatattaactccaatgaaattaaatctccagtaatgataactgctgtgctttcatccctaagagtatattgaattattttttaaaaaatgacttgtggctgggtgcagtggctcatgactgtaatcccagcactttggaaggccaaggcaggaggatcacctgagctcagaagttcaagatgtgcctagtcaacatggtgaaaccctgtctctacaaaaacacaaaaattagctgagtgtgttgagaatcgtttgaacctgggaggtggaggttgcagcggggagagactgcaccattgcactccagcatgagcaacaagagcgaaactccgtctcaaaaaaaaaaaaaaaaaaaaaaaaaaaagacttgtactccttcagctctagtttctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaaaaaaaagattgaaaaagaaagaaaacaacccattttgtgctctggttaataaatggagggagagaaagccagctaggcatcaaccactgtctccaaccattatcatctgcatttgtgcgcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggacagagacatccatgtgtgctgcattccagcaatgagaatgaaagcactgaaattacatgcaacaatcttgcaaacacaatgttgagccaaagacgacaaaaaagaaaagagtgtggctttatttctatgttaaaacagcaggcaccaagaatctacggctttagaagtgcaggtggcgggtggaagatattgactggaagagggtgtggggcggggttccagggagtgatgacctggatgatcagtttgtacgaagccataaagcagcatatttaatatttgtgaattttctgcatttttgttatacttcaaaagtttaaagaaatcattccaaaccagaatgagcactgtgggaatgagtttttcagaaatcatagacttaacttctgaataaatgctctcccagcccctgctgagatgccaaagacattccaaaggcacagactgaaaggacagaatgctcacagccaaaactaccgggatttctatgcagaaatctgggctttgatgctttagaggggcctctgtctccccctaccagacacaaagccagcagcaaggccttcacaatgggcttgccgaacagccgaaaaggaggttatttattaagccacaaggagaatgcacctacagtcatgtttccatgcaggaatctgtgacaactgaaatgccccatatgagctaattttctggataatcaaaatcccctcattaaacaactctgtcatttaaaataaaatcatttttattggatttaatcctttctaaaatggatttcatgcattcctgggtctacatccaggacacactccgtgcttcctacgagaatgattcctagcaagactttctcccagagagttccacatgcaagcagaaagaaaccaatgtgggctttagcaaaggaaggggtaggacagacgtctccattgtcagcaagaccacagaacaatggacttttcagaagagtccatggaatagaatctaacctttacaataaataacaacactcacatttaggtactgtctatttcccatccaaaaggctttccatcagattttctctcttaggtcctattattattcccatgttagatatgaggctatgaggtatgagaaactctctctccaaagcctaaactcctaacccctgtgctatcttttctttacatcttcagctatggagtctgtgttacactccacaatgccaacagacagagaggaatgctaactgtaacttgaatgatttgagttctcattgcttttctcccatcttttctttctctttcatcaatgttatacaattagttttttcataaagctcctactagcaagctactcctccccacactcagaaaacctcctacctaaaatctgataaaaatctttgttttcactactttaaactcttggccttcttggatctttctatttgttaaaatatcctatggagttggacaaacttctttatcagtttaagaaacccctctgtttctgtgcatttcaaagcatcctggatttgctttttcttcacccaactcagaaggaaacctgggatgctcattagattaacaaaaactgccctcaactggggcccatctggaccacagtcactctccagaaatacaatgggagcagataggaactgaggcatgccgagagtcaatttctgtaaggtttatcgctcgcagacctgtggtgaaaaggaaactgccatccttaccccgttttcaggctgaccaaggcgtcctctactcctttctgattaaatttggtcatgtactgatgcatgtagggatagttattccgaatgtttctctccgtgcttccattaggcactgtcccaaatcgaaaaggtggggaatagtcatgaggtctctgaaactggagagagaacgagaaaggaagagagagagtaggaaaagaaagagaagggaggagggggaggagagaacaaataataaattagtgatcattttgtctggtgttaggaggtaaatgcatgcattagggcaggatgacaataaaatgttgctttttggtctttctttctacttagtcacatcttcagccagtctgtgagctccaggagggtggacacagcatctgttttcttctgtactactgctcagatcctagcacagagcccggctgggtgctccataggtatttgttgagttgaacttttcagtgccattacagagactagcacagtgttaggcacacagtcagtacttagaaatgctgaatgagctgaacttaaggtactaccttagtccagtccatttatccactttatgatgaaattttctgtgatctccaccaatcactcccttctctaaactccatttataattaccttcacctcacccagaaaatgactatatattaccactcattcattctccactcactcagtcattcattcactcctgcaggcactatttatctagtgcctaacattccccaggcataattgccagtgcatggcaggctccatgaatacttgttgagccagagtccctgttgatctttagctatcagggatacgcagcactcggcactcaagccccccataaaggcctgtagtccatgcatcaccagtcttctctgatggattggatgattctgtctgtccacagcttcgatgtttcaggtgactcaatgagagtcgaatcaatagaactggatctgagttccagaaatacagctaaacactagagatggtggcgggctgtggttataagcaggagctcgaactggctggttggaaaattgggttctatcacatacaagctatggaaccctagataacacattcacttcatgctgcctccatttattttccatctgtagagtggggggccaccatgaagatctcaacatacatttgtcaagtaactggaatagtgcctggaccagagaaagcattcaaaaataaagctatgattaccgtctgttattatcattatgagtgaaaaaggaacctgaacctcatttttctatgaaacattgaattctggaactagaaagtaataacaacaatgactaacactttttgggaacctagttgggtccagcactatgccaagaactttacaaacgtcaggtcatttaatccttacaaacccatgccaggtagttaatcttagaggctgcttcttgcagataagaaaactgaggctcagagaggctatgtgatctatttaagattatgcaactaccaagcagtggcccagaattcaaacccggatgcgtctgaccacaggctgaggtcttaactctatcattcctcagagaccattgctattgactctctcctcatctagacataaagatttaaagaccccaggaggggaagagcacccagaaaatcagtgtcagaaccaggaccacaatgcagcagtctctccaacttccagaccagtgtgtcttccacagaactaagaaccgccagggtaagtgtccaaatttacccaagagtcaaaccagctagaaacattattcttttttccagactcacacttcacttcactgttaattaaaatttccagttgaaaatcgttttccctaaattaggcatgctgctgcctaatatgcagtcataactggatttgggagaagtggccatccattttccaaatgagatcctcctgccagggtgtgccttgccctgggagtatgtgcgtccacgtgtgcatgtgtgtgtatgtgaacagcaaaatgctttttgcagtcactccaccaagcagtgccttaactaatcaccaaaagctcaaaaggccaagcccaggctcatcctcatggcagccgcctgctcgggaggagagaggtaatagtgctgttcataaatctccttgtagcagccattcccaatctccagagatatccggagatggcctatttgactaaatgccttccacttcactccccgtctgttgcagaggagctgcataggtctttaaaaattcactttcttccctgtgtctgggttgcacagtaacagagatagatattcagtctctgtgatggtttccgtgcttctctggcctggatagtaccatcacccacacaaaattcagcctgacaccaagctccaggaaccttttccactagactgaagactgtcaaactttttaaagcatgactcacaatacgtttcccatcaccactccatgcacatgtgtgaaatttcacagcactcattctttctatctgtgatatactctgaggttatccattatgttctatttttttaaaaaaatgtctgcaatccttagattaatttcatggctcactaaagagtcatgacctacagcgtgaaaaacagtgagggggcaaggatggctcatctattaagtcccagggtctacatccaggacacactccgtgcttgctgcgagaatgattcctagcaagactttctcccagagagttccacgtgcaagcagaaagaatccaatatgggctttagcaaaggaaggggtaggacagaggtctccattgtcagcaagaccacagaacaatgtaatcacaatatctggagtcagaggaactcccctggcttctctgcagggttcccttgctgtgtaggttaactggtttcacctggctttggacttacaggagacaagttcaggttctcatctgctgcttagaaactgcgccatttggagcaaccagttaagctcctgagcctgaatttctctatctgtaaattggagattgcttttgcaacaaatcttatagtgtttgaaagaacacctggcatcctctaatgcttgggatagatcacctgttgttacccacgacatttcagccaaacaatgaagcctgtctccttacagtttggagaacagaggattattttctaattttttttccatccaatatggaggcatgtctgaaggtcatccaagtgactaaaacatggcaagtatttgatgatggaggaggtagagatgcaacacttggagataaaatttccagaaaaatgcagcaattaaccaagatattttttctttttttgtgaaccaaaaactacccatttattaaaaatatctatctgtcttctgtgcctgtaaataagggacatctggcaactggagcccctatttctagtacagtcttctgttggtgaagtcccacgtgcttcttgatgtgagcagcaagcaggtgtgtccttgagcagagagaggatcagctgggaggaggcctggctgcctgaactgggaccactcagcagcagcagcacagtgcccagagacagcatggctccttgagaacacattcctgggctcatccactgagagcagttgcctcaattccctccattggttgtcacaaaagaccaactcagtgcaataacatttcaggccccagaagccaagaatggtttgagtcaggcgatgatgaagatgatggaaggagtaggaggagaagggagacaaagagaaggagagggggaggaatgagaggggggagtggaaaggaggagggtagaagaaggaaataacacattacaggatcatctaccatgtgccaggcatggtgtgaggattatttctaatcctcctatcaaccttgccagaaaggagataatgtcttctcttttataggaaattaagcctaaggggatactgacatacagaaggccaatcatatggcaaggccaggatttgaacccaggtccatttgaccccaaacatgatattgctcttcccacaacataaatctgcctcccagagatggatttcctctgtcagagtgattcccaacattttggaaagcatccctatcaacattgcaattttctcttaataattcctagggaagcatcttacccatgaattcacctatttataatttaagtcccagctcatctgagcacaccatgggctccaatatgattatttcacagcaagcactaatggcttaaaagcattgtaaacctgagttgttacacaggtattcatgataaacaaacaacaaaaaaacaaaaacaaaaaacaaaaacaaaaccaaccacagtgtacaataaattgattcaatattgatttttttttgcagactttcttggtgtatcttctattaatcttctgggagcatataggttatttactccaggaattttgctgtttatctcattgtatcaaacatttaattaaaagagctatcagcttgcctctaatgttttcagcatggagactgagctttgtctcttgaggatatggtatctgttactgggtgtttccaagtcagtgaaggtcagtcaaattattagtggttttaattagttttcccacaagtggtcatgttatttagacccaaaactatgtagtaaggatttccccccgcccttgcctttgaacatagcaacaaaaagcaaaatatgctgccaaccactttcttgaaaaatcctctcttccaggacattgcttcctgctgcttccaccatacctccaatcacttctaggaattgcacttttgatcccataatgcgacagacttgcacaatagcgcttcatgtctgcagagggattcatatgctacaagatacatttacatatgtggctttctttcatccttactgcaattgtgactcccaaatttacaaagcagacaaagcaggcaccgtgaggtgacatggctttaaaaacattatacggctggctggcgagtggcagagaggaaacaggcagagaggaaacacaacttttctgactctaaacacagtgtgttatctgctgcctctgagataccacccgctttaggcggggatcttacagtagctgaccccaagtgaaggatttgggggtgagcatgatttactagtgaagggttccaggagaagtcagcaggggagcaggataaagttaggaaagactggagaagggggagaaatcaagggtctgatttaaggccaagtctccatctcagtcccgtcctgcagggagctccagagagtgattcgtaccttaaagtttttcctgcttcgaagcaagggagcagcttagcctttgtattctcacacagattagtctttggttacaggtgaccacaaagattgagggaacttaaattgccaggcatttaccattccagtgcccaaaggcaaaaatctgctgaggatccctgaagtgaggctttgtcagcaaagcacagaaaggtggggctgggcacacagcgctgcaaaagggatcccaggagatccaggtggggtatgcacagtgtccagtataccatgcatgtattcattcacccagcaagagtgtcctgagcacctccaaagtgcaaaataactctatcaaaactacatccctgagggcctcttcccccagacaattttagtctcatcagctttatcttctttataatacttattcctgccccaaatttccaaatttgtttcttccttgatgtttacttgtgtattgcttatttttttcctactagaatttaagtttcttgggagcctgagctcattctgccaagtttattacagtagccaggaaagacttccctgaggaggtaatgtcttccctaaggccagaaattccaggaggagccaaccatgagaagattggggaagaacattctaggcagagggcctaagaggcacaaggacactgagctgaaataaacttagtgacagggatggagcaagaggaaggaaacgtgggagcaggtgagataacacagggctttgtgtgccatggtaagtaaagtgacccttactcaagcctcaatcggaagccatcagagagaggtgaggcactctcatgcctttgtggaaatgactccatctttaaccccaacccctcatcagctctcttgacaagattctttcaaccacagtgtgtatcatggataagctgtaaaagctttccatggattgattttctattcagcagtttgttgatgaatggcaaaaggatatatgtagacttatgtcaaaaagatatgttagcgaggttttataacgagagacaaattatccccacacacagaacagaaaatctttgtggtgctgcaatctcaacacttgctgagcttagcaagtcaggatgtttcctgaactaaagtctcaataggaggatgcacccagtttacctcttttcttcctcaatgtgtgtttctgaatagctactcaaaccctgcaacccttgttatatttcatttcactggagaatgagagagcaggtgtttttactcctgtcttactgatgtgggaagtacagccctataagggaagattagtgatatatctgagtagaaagaaccagtgggaaattaaaaaaacagaaagaaagaaagaaaaaaactctctgctccttttgtgtgccttgaagacatttcaggtgagtcagaagcgctgatgctgagactgatttggctgtatggaaaagaggagctgtcagataattttgtctctgggtagggcttaaagatgactttttttcaggtcatagatgaggtacccacagcctacagtgctccttcaccccaatttcttctcatccaggaaaatgggccttccttaacatcacacattcgaaaggatgaatttcaacctaagcacttgagtcataggtcattcacaagcaccatcagaaagatcatataaataggaaacacgaccactcggggaagccaggcttccaaattagatctggaatcttttaggtctaggagagctaaccttaatgttctgtttcaaaaactttgagaaagaggacaatttgagttaaagagaaaaaaccttctggcttttgtgcattcgagttgatggatctcaatgagaggcacctgaatctcttcctcctgaaaggagagcagttaagaccaaccctcagatggagaggaaagcaaggtgaccttacctttttgtcactgaggccggtcacttggtccacaaattcctcttggatcatgaaggcagccagattggctgtgtagctagccaggaatatgacagcgaagaaggcccatacagataccatgatcttgctggtggtccctttaggattctggacaggcacggagttattgaacaccaggccccaaagaagccatatagcttttccaattgtaaaagaaggcccatggggtgctgcagaagatgaaaaggacattctcagcattttctgaaaaaaatgcctgtttgtgtatgacaaccacgcagcagccaccagcagcaccgaaggttgccagaagatggaattatatcatagttgtgtcctgtgattgccctagaaccacaataacttatttttttctttaaaaattagcattcttctcacatttctatctaactggatttttgccacatttctttaaaaaaagaaaggaaacgaaaatggttatgcaaaatgggggtttgaataagtagtgttatgacctgttttaaatttggatttgattcccatttgaggaaaccagccttcttaataaacataaagagagcctgacaaaaatgtgtgcatggggactgcttccaaattcatcggatgtgctatcgtataagaaccatgcaattcagcgggactgatgtttggtattctaatccgattgtccctagcaattgctcctgttcaaactcagatgtaaagtgtgtacaacataagaattaaaccaaactaaaaccctctccaaatggagacattaaggaatggaacaatagatcttaattcttccaacacttcacagatggaagacatttcattgcagggtcatggaaaatgaacactgatgtcatatcacagcactttttccagtatatcctcgcaatagctatgcagcccttttaagattcttaaatgttccttgcaacagacttaactaaagagacagaatgatatgccaaaatttatggcgatggggcatatgcaggctgtaaaacacacatattagggttttcaagtctttgttctgcatgggcaaaaaaaaaaaaaaaaaaaaatcaactgatgccctaatttcatagggaaggtttccctttaacaggaggttaatttttatgtcatttaagtaaatgaagatatgaaaaaatgatctactcagatgtcacctgccaatataagcagagtgggcaataaataaagtggcagaagcaaattcacattaatggaagttatgaagtgctgggcaggaagcctaggaaaagcaagctctctgcacattggaggccaaacccaggctacagctgtacttataatatccatgacacaacccattaaagagaaagcagttaattctcttattctcaatctctcctgtttctatttggctagttttgtgatcttctgggcttattctcaagaggcaggaaattcttggggaaaacttagagttaatccagtcaactttatgaacgatttagtttttttagggatgcacactgatcagaaatgacagctatttaggaatcagatgtaggcagttcagaaggatcggtccaagacttctaggaattcctgattcatgaatactatgactgggccatataacttttcccataaagtgcagcgaaatgtaacagaaaaccattttgtacaaagaaacaagtagctgtcatttcccaagagttgccacagcagatgagctggaaacagagagcctggagagaatggaagggctgaggagtttgcacaactgatgccatcctttacaatagtctttccagcatgcttcaggcaaaggagaacgtattgcaaggatgggctgtgggtggtttttaccttccaaaatgtaactcagatttacctgattatctgtattttcgttgttcttgacaagttccaagtcattgcagtcctttctcttggaaaagtgacaccttcttaactgccctccccgtccccgcttccaactgttgtccccacacactatctggatagagtagccccagtgacctttttgctctgtacatgtatgtcacctgtctccctgccattgttttttttttttcttttctttttctttttttttttttgagatggagtcttgctctgtcactcaggctgcagtgcagtggcacaatctcggctcactgcagcctccacttcccgggttcaagggattctcctgtgtcagcctcccgaactgctgggactacaggagcataccaccacgcccagctaatttttgtatttttagtagggatgcggttttgccatattggccaggctggtctcaaactcctgacctcaagtgatctgcccacctcagcctcccaaagtgctgggattacaggcatgagccaccgtgcctggcctccctccattgtattttgaagaaagtctgacatgcttcccatggtcaattgcctatctctctgatttcatcttatactattgtctacctcattcactcacatctttttattttattttttaatagagacagggtcttgctctgctgactaggcagtgcagtggtgtgatcatagctcactgcaacctaaacctcctgggctcaagtaattctcctacctcagccttctgagtagccgggaatacaggcacgcatcatcacgccaggcttattttatttatttatttatttatttatttatttatttatttatttatttattgtagagatgaggtcttgctatgttacccaggctggtctcaaactcctgacctcaggcaattctcctgccttggcctcaaaaagccttgacatcacaagtatgagccactgcaccccctcagcctttttctgtttcttgagcatctcaagattatttcagcctttctgtttgctgttccttttacatgaaatgactgtaactgtttttgacagataaaattgtatgtcacccttcaggtcctagctcaatgaacatcctttcccattggaccatcttatctaacgtagtgtctgcaccccatcactatcatgtcactatgtttttttcttcttcttgatatttattataatctgttattattagtttgtgtgtctacatgttattttcacaactaaattctaaactgcctgatagaaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatcttcttagaggttaaattaccctttaaatgaaggcttgcaatctcccattaaacacaacatcattatttatggcattgtttagtatctggttgattgaagatggtttatgtggtaatcaccactcttcaatggtgaggaagaagttgaaagatttcaataaaactaggttcctaatagattcccatgacctgttgagtatttccaatattaaaacatctaagtgaaaagaatatgtatccatcacattaaagtgctctgctttttgggggatatgagacttcaagttccatcctctaccatatcaagtcattttttgggaaagagatttggtcctgacacttttctgataacacccatttagaaggtagtgcccactgaggaaagcccactcaaaatggcataacgtgtatgacataaaccctggctagagtgggatccttttaatgagttatagctaacgaatgcctcccaattttatttcctatctactgattgtccctttatcaactacaatgcactaagatcaatgcattttattttagcacacttgatttcctcctggcatcaccaacaggaaaatataaccctatggggaaatatatcacttcatagttatatttattgtcaaactaatgtaaattgattcagtagtttgaggaatgttcttaaactagattttataaagtcattttctttgcatagactgaagttgaaacccatgacaattttagcatttgacaagcattttttaaattaattgtcagaaaagttccttcaaatctgctttcccaacaaattgaacatcagtggttttcacctaacaactattgacttcaggttatgacaagattaaaatatttcattttgttttatccatcagttgaagtacataaaccatacttttctggtattacaagcaatatcagtgacccaaaaccattcatacaatggtacaccaacgcagtataatgtattctttgtgtgtgtgtgattgagtctcgctctgtccctcaggctggagtgcagtggcacaatctcgactcactgcaacctctgcctcctggttttaagcgattctcctgcctctgcctcatgagtagctggtattacaggtgtgtgccaccatgcccagctaatttttgtatttttagtagagatgggtttcaccatattggtcaggctggttctgaactcctgacctcatgatccacccacctcggtctcccaaagtgctgggattacaggcgtgagccaccatgcctggtctagagtaatgtgttctaaaactgaaattttcattaaaggtaaatgaaattgcaacaacattgaatcatgctcatgaaggtacccttacctttccctttggctaagtttctgttgtatccaacagggctgaagtattcaaagacaaaaacagctatggcagaaacaatgagcagcatcacaaacatcatcacccagacagaggcgctgaatggttctgcaaataaacagataaaggaatggaaacgtggttagttatctcttcctcacttccagcaggaagcccagacatccatttgcaggctcgccaaaaatattttctctaatttgaatctgatccttcaaaagaagctaatcattttttatttttatttttattttttagatgtagcttcactctctgtgtcacccaggctggagtgcagtggcacaatttcgacttgctgcaacctccgccccccaggttcaagcaattctcctgcctcagccttccgagtagctgggactacaggcatgtgccaccatgcctggctaatttttgtatttttagttgagacggggtttcgccatgttgcccaggctggtctcaaactcctgacctcaggtgatctgcccacctcggcctcccaaagtgctgggattacaggcgtgagccactgctcctggccagccagacattttttattcatcattttaaatcattctttattctacaaaatatttgaagtataagattgcatataatataataaaaatagagaagagcataggacattttacaaattaggtcaaggataatcagaagaaaaaagagtgataagaaagagggagcaagttagaatgcaaataaacaggccatagtttcctttgtaattatagaaccatccagggggctaaagctaggaagaaaaaagactagacccaaatagtaaaccataggctcctgcaaattgttatggtttttatttttattttttcatgctagaaagatgatatgcagggaattccaaaaataaagggagaattataacctgttggaaaagaattataaaatcatgggtgacagaaatattggaaagttataatctaccacactctccatttcaccttttgcctcagatagatgagattcctacagctttattaatcttgttgatgttggtagcagccttaaatgcaattgaaagtcaattgaggatattatcttcacatgataattcaataaaaaagcatcacttaaagggtagaggcaataaaatagtagatggatagatggttatttccactaaaagtagttttcatcagctcatttgcatgtaacttaggcagtaggtggatgtcttagaagggcaggccaagtcataaggctctaagccttgtaacactctagaaaggtaagaaatattatgtaaaataagattactattcaacttgattgaggatatgaaaattagctgactgcagccattttatttatggtatagatttgctataaaatcaacagaaaataaattttaaaaatgaatacatctccacctgaatgtatcatggggaagaaattgcctatagacaccaatgaacttaaaacccttttcctcataagcaaatattttctgagggttaaaataagtccaataatacttcttgaatagtaaacatattattattttaaaattgttttcctagtgaagctacttataataataaagagctaggttgatagcaggccaccttcttattagagtatgactacttaacacagctagaggtcaccacaaattccaatttaatgagtttaatgtataacaagaaactaatatgtccgaacttaactttagctatattggataatttaaaagctgggaggaatgctttctaatgcatttgatagtgcaaatatattaaaaagcaacaggtaacacaacttacttaagtaacacaagatgcgctccaagaaatcaatgaaactgcaactgaaatttattttaactttagcttgagtaataaacaatattatgtccctgaaataatagcaatttaatactgagttgtatccaaaaaggaaattagataaataaatgattaggagatttataagtacttcatattcaagaatagagataaaataattctccgagttgcgtagtgtgtcttattggaggaggatcattatgatgagcaaataagcatatacatgaaagtgtttgttcgtgtgtgaggcacacaatatacagacaatatactgagtggaatagctgtgtgattccaggattaaagccagaaatactggggcaacaatacgctgtccatggttctgaaaagggcgtgctggtttttgaaaaagcacatttattaatctggtaacgtctatttctctgcaggctgtgaaaacattatttttaaacattagaagggaccataactgaattatcctatgtgcatgtaagaatctgtaaacctgcagtgaactttttttggtaggtgcatccttgtcactaacacgctagtcagaaaatcaagtggaaactgatgaagcaactgttcccacatgtctccccacttggaattgaccacatctgttccttaacttgtgagcacagcacggatcaaaggactctgctgcagtagtcttgttttagtaaattaagtacctatcagtgccctgaagggttgctattctaagataccacacacgtgaatgcacacacatgctccagaacaaagaaacatcgttaaagcaacatctatagtgtctaaggagtgacccagaaatagtttagataactctctattacatcttctaatggcttaaaacagattcaacatttgtccatgaaggaactgcaatcgaggagataccaggtcagcatttctttggatcaaagaatccaacttgtttggaaactcttcagaattaactagatagaaatattacaggagatgccatctctgtccttgaagagccactggttacatttttacacaaaagcttagaggcattacctgcaagtgcttctgatgtgagttaatggagtttgtggaggagagaaaataggaaataatgaacagcaataaaatcagattttgaatgttttggctcttccagatgactaagccagtgaatggaaaaatgtagcttagctggttcattatgactttcaaaatctgtagataatgaccgtaaataagggggtgcacagtcaatcaaatagggatgtaatttagtgactaggaaaaatattaagcctactgggtaaaaacagctttgaaaatagtttcctctggttacaatttattttacttttaaaaatgcagcaggaaaagtgtggggaaagagaggttttgctaaatttagcaaaatacttgacatttttatggaaatgttttacaaatgcaagcaagataaaaatctagagaaactgggttgaggccagattcaatattcacgacccattttcataagacaagccaattgatatttttttctctctgattgaattggaaaaagagttctctctagctcactaaagagatacaagacttttttgtgtgaaaagaaacaatttctttccattttgatccatgaactcacttcctctaaccctttcttaacctccaggacaaaggattcctgccaaagagtctgaaagggaatgaggggaaacatgactaggagtgactaaagagtgaatgtccacttaagaattattaagattctgcatgtgttgtcaatatcagctggttgcattgttcctggcatagtgaggctctcttattaaaatacgagtatctgaatccatgtcagacggagggacaaaaggaacataatgaggtgtgtatttgtcagggtccacattactccaacaaaggttacaaaaattgaagcaacgagtgcaaaatcaaatccagagagtggcaagcattttaacagcttaaatggattatcaaaaatgaaaacagtaaatccatagcgctctgaatgtaaggcagtgtccaaaatcctgttagtcaatatttcactgaagagaacgaaacatgaaagtttcactggatgccaacattacatataaatgaagacagtggaagaataagacaatgggcttggagttggtgtccacaaattggtttcagtttacaatttgctttaagagataaagttatttttgtctctggaaaaatataagaaagttagttgactttaatataactgttttcccaggggggagatttctcaaacaactaaaagtagatctaccatttgatccagcaatttcactactgggtatctacccaaaggaaaagaagttattatatcaaaaagacacttgcacacatatgtttatcagagcacaactcacaattgcaaagatatggaatcaacctatgagcccatcaactgatgattgcataaagaaaatgtggtatatatacattgtggaatactactcagccataaaaaagaatgatgcaatgtcttttgcagcaacttggatgaaactggaggccatcattctaaatatatgatagtcatctagcaaataaatgactgttgttctttgtgagatggaggatgggtatgtagatgctgaataaaggtttatgggctgatttaaattaactgtggaccgacaggtttatttttaaaatgttttcaagactctaagcaatatagctattaatttacattccacagtgtcaagaccagtatctgaatatgtgatcttatttttttagcagctttttctaagtttgagataaatgaaagatgtgaactgggggatgggtttttcaagaatggaaaatctaatactacatattctcacttctaaatgaaagctaacctatgggtatgaaaaagcacacaagtggtataatggacactggagactcagaaagggagaggatgggagggagatgagtgatggaaaattacctacaatgtacactatttaggtgacaggtacactaaaggcccagacttcaccactatataattcgtccatataaccaaaaatcacttgtacccctgagctattgaaattttttaaaaattatacatatttttcccctctcagttttcctccagagattcacgtttgtcttaaccttccctaatttgggacaaacccacttatatgggagtgccaagggggaattagtgatctgaatttcatgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagactattcctattagcagaatattggcataaatcatcgtgcagtcatcattattttcactcttacatctagcaaataaatgactgctgttctttgtgggatggaggatggatatgtagatgctgaataaaggtctatgagctggtttaaattaactgtggacagctttatttttaaatgttttcaatattctaagcaatatatctattaatttacattctacagagtcaagaccagtatctgaatatgtgatcatatttttttcagcagctttttccaagtttaagacaaatgaaagatgtgaactggggatggaggggagtgaattaggatgtattagtctactctcacgctgctataaagaactgcccgaggatcacttgaggtcaggagtttgatatcagtctggccaacatggcgaaaccccatctctacacaaaaattagccaggcatggtggtgggcacctataatcccagctactggggaggctgaggtgggagaattgcttgaacccaggaggcagaggccgcagtaagccaagatcataacactgcactcaagcctgggcagcagagctagactccatctcaaaaaaataaactgtctgagattgggtaaatttataaaggaaagagatttaattgactcacagttccacatggctggggagtccccaggaaacttacaatcatggcagaagaggaagcagacacgtcttacatggcggcatgtgagagaagtgaagcgaagggggaagagccccttattaaaccccttataataataataatataatgagagccccttattaaaccgtcagatctcatgagaactcactcattatcacaagaacagaaggggagaaaccatccccatgatcccgtcacctcccatcaggtctctccctcaacagctggggattacaattcaagatgaaatttgggtggggacccaaagcctaaccctttcataggataattcaaatgcagcatcctctgaaatatgctgccatggccaaacagagctaaacaagttcctttctggtcccatcctctgagcaaacaagatttcctacaattccttataggaaagcaatagtcactatgaaattcacacacctagaaaagcagaaggtgagacggtgccattacttcttgaaaccatgacactgattcccgtttccacaaagggcacagagaagtccaccacttcagaacgttcctcattgatggtgagcgagccaactgccatgactgcccgttgatagaccacctggatgcaaggcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaaaaaccccaagaccacagaatgttagcactggaaggtttgttcacaatcattagctgtactcttctcctatttttcagatgagtaaactgaagtttaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatcttcatgacattttctgaattagttgatatttgtacacccattaaacaggtaaaaattaccaactcttaaatttttaagagtttataacatacacaactttagactagagtttagtcatcagatctaaactgagtcataaaaacttactagagaatggaagagaggaggatgtgaaattctcagagaaagcaaggttttgcttcattctataattacagaggcttgaaaccaaaggggagaagtgaaggtacccagacaacacctcagccaagaatcaggagacctgggttctattccatgcctgattttgtgcactgaacttctcttgatagagccaaatgttacatgagggctcattaataacatcttccctacctacctatgtgacatgtagtataaaaggagacacttctaaaagcaaggtccttgatcaggtaaagaccccattaaaatttaaactatcttaaaggctattgtatactctaccaaggctacacttactgttttgtaccagccaccttgctgtattcacctgaacaagacatattcaaaggacacccaggcaaaccagaaaaatacctttaaaaagaaaggaggccgggtatggtggctcacacctataatcccagcactttcggaggctgtggcgggtgaacacctgaggtcaggagttcaagaccagcttggccagcatggcgaaaccctgtctctactaaaaatacaaaaattagccaggcatggtggcaggcacctgtagttccagatactcaggaggctgaggcataagaatcacttgaacccaggaggcgggggctgcagtgagccaatatcatgccgttgtactcaagcctgggtgacaagagtgaaactctgtctccaaaaaaaaaagaaaaaagaaaagaaagaaaggaaacactggtctatccaacggatagcaaaaagtacttagacaattcacataagatcaaagcctttcttctgggcaatatgcttgattaatggacatcccattagctcaaccctgtctttgagttatgcatttcatgaatatgttctctgtttgaatatcccatttttggcaaatccacacattggagtgttacctaagcactaaagtgatgtctatggaaatccaacatcatcacaggaaaattcttatgcttccatgtcatatgaaaaaagtaggttacacagtagtacaaacagaataatcacagctatataaaaacagatgagcttatgaaataactgtatggaaaaacaatgaaatatgaagcataggacaggtgcagtggctcattcctgtaatctcagcactttgggaagccaagttgggtggatcccctgaggttgggagtttgagaccagcctggccaacatggagaaaccccatttttactaaaaatacaaaaatgagctgggcatggtggcatgcacctgtaatcccagctacacaggaggcataagaatagcttcaatctgggaggtagaggttgcagtgagccaagatcgcaccactgcactccagcctaggtgacagaatgtgactctgtcgagagaaagagagaaagaaagaaagagagagagagagagagaggaagaaagaaagaaagaaagaaagagagaaacagaaagagaaaaaggggggagagggagagatagaaagaaagaaagagagagagagaaagagagggagggagagagaagagagaaagaaagagaaagaaataaaggaggaaacgaggaaaggaagaaaggaaagaaagaaagaagcaagctattttggaacggtgaaaaacatgttttcttttttacatttttagggtttttccccaaattatctagtaagtacatactacttatgtaattggcaacacagacacacacacacgcatcaaacaacattgatttacatgatatacatcatctctatatccatgaaggtgggcagatttgacagaacaattttttaagagacacgctcttgctctgttgcccaggctgggttgcagtgatgtgatcatggctcatggcagactggacctcctggcctcaagtgatactcccactttggcctttcaaagtgctgggattacaggtgtgcgacaccatactcaagctggaaaacataattttgagtaacagaagtgggttgtaaatgacacctgcttatcaatgctttcctttatctcaggatcacagactgcctgtcttgaatcactctcttcaccattgtatcccacccccacatcctgtcagtgacttgtactcaaccactctgcttctgtcaacccagaccaccatagagactttactctcttgcctagaggctggatgacctgctgtcatccaccacccttagtgggggggtagtaggaggccacatctgtgtatatttacatgtgatgattagtgacctcaacactgtacagtcatgggatatgtgccagctccatctccaccaattacccagaatggagggggttgggctagagttaaaactgccacaaatatgatagaaatgtgtcctaagtacattaaagttgatggaatgtccagataccatttccttcttagtatacatggctctgaaaaatgtgtcaaaatcgaattctctttttctttctggtcgctgttggccatgcactgatgccctttccctacctctgttcatttgtatcaccttcattctatgttccttcccttcttcccctatcacaggctcttccttcacctggtcaagatttctggaagattagagagaagttttaggtgccccaggtttaagattcaaggtcacaggcatatagtggcattctttggtctccctggaaacctcagccagtttatgagttatctcacccatatccctgaacatgaggtatatttctaaatacaaatgatcaatgacgcattttcacccaacaagcacccactaagtgcctactgtgcacaagacatggaactgggccttggggacacaggatgaaaaaggcacgcagcaaaggcaatagttgaatttatcacagtaattatggaattgcagaccagcttgtaattgggaacgtctgttggttcctattacagcccttgtgtgggtgtgcaggggatgtgacttaactacacagactgagaaatggtccccatgtgatctctcttagtgctccaccaccacccaagagagggaatgactcacaaaaacaaatacggggaaagggatccaacaaattgtccagtttaccagctctacaatttcccagtatagccggtggatgtgagcacagccatgcgagtcagagctgtgtccaggtcctgggttggctcctgtccaccacgcagactcagacaaatctcatccagcacttaaaaataaatttcctttcttcccaccaatgatttgacagtttgggagcttaattgacagcatggccatttctcgctacacatcaggccaaatgatttttccaattttctctgcatgtctttatcacccaactaacagaccagaaaggaagatttctcagctcatttccggttacctggtattcttagaagatcccaccacttgccagaagtgagaaacaaaaaggtttcacacaatcatgttgtctaacaggaattctttttgcaactgatcagccttcctcaaagacgttccctataggaaatgcaattgatctaatcttctttaatgttgggattagtggatcctagcaattctctattgctctcacgagtcagactttcatttcatccagacacagtaaactcctcatatccccaagcggaagaaggaaagctgcaagctactatctcctcacagaaaccaaaaacgtgaatttgaacctgttaagctgttgatagtcttcagtagaaaagtcaattcttttaaagacagcaatttattttgatttctcttcctcatacaaatgtgactcagtacttggggatctacttgttttcagctccagggcttttgattttaaagactctaaactcctattattgattctggagcacacggggcctcagttgattgccctattgaaacacagagggtattgttatcataggggaggtgtcccactgaagttagactctgctttgtgccagccactttgctttcttcatcgggccaagttctgctcaaagaacacccacccaaattagaacatcctctgacaactttcccacatcatcccctccatcctccttgtaactcatcactctctagcactgcactgggtttcattccgtttcccaaactcccaagctcctttcctccccagggcctttgcacctgccattgcctctacctggaaggctttgcccagatattcacatgtctggcttcttctcatcctgtatatatcaccttaaatcttatctgtgtgagctaaagtaaccccacataccccgatgtactctcttctcacaccactctctttctgttcatcacaaggtttattacaacatggggtcacccatttcttcctggtcgaattgttttctaaccacgtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcctgaccccaaaacatggtctgtttcacacaattatgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaaccaaaacaggccttcacaatacatttagcaatcacatattatatctttaaaatcctgatctcaaggactgagatctgggcacttgcatcttgtgtgataatagctgagactggagtttgaaacgaggaagtaaaaatctctcttcctagtcatgaaacaaacattggtgtgtcatgctgtgcccttgtaactgagggtgcaaatattaataagtcacattccctatatgtaggtggctcagaagccagggagaagacaaactatacactgtaaagacaggtgatgagggtagagagagatacacccaggtactgtggaagtaggaagagctaacccagcttggggacgcaggagctacacttaaaggatgagtaagaattaggtaaaagaaacagatcagaaaagactcagaaaacaaataaagtttccaacagcaggcctttttcttctgtgagtctcctgtgaggtggtgtttttgcttatgtttgcattaggaaataccaggatcagggccttggaggtggccatggaggtttctgtgtccccagagggtttgtagattaaggggacctcataatggacaatgccagctctttcttcaatcataacaaaaggagaaatgacacagatgcagtgcctgctggctgttgctgagctgagaaactgccagaagttccatttgcacctggattgtatcagaaagtaacatgcaaggtgtgtgttcactcccaaatggagagacgtttttaaccttcttgagaagcatagatctgggatctataaaagagatggaagaagaatgtgtggggggaaggaaagggacagccagaaaagtggaaactaaataattatttttaaaaagactaaaggaagccggacacagtggctcacatctataatcccagtgactcaggaggccaaggcatgaggatcacttaaggccaggagcttgagaccaggctgagtaacatagcaagactcttgtctctaaaaaaaaaaattaattaaaacatgagccagacatggtggcacaggcctgtagtctcagctattcaggaggttgaggtgagaagaacacttgagcctaggagttcaagaatgcagtgagccgtgatcacaccactgcactccagcctgggggacagagcaagaccctgtcattatataaaaaaaattaatgttttatatatttttaacacataaaaatatataatgttttatatatttttaacacataaaaatatatgttttatatatttttaacacataaaaatatatgttttatattttttaacaaaaatatgtaatgttttatatatttttaacacataaaaatatataatgttttatacatttttaacatataaaaacatacgttttatacatttctaacataacagtaggggcatatttatttattccatgatgtattcaggatttcaacttcaaagaggctgacatttgtgacctcattgataaaattttctccaaaccaaaacaggccttatttttatatgttttatatatatataaaaatatatatgttatatatgtttaacatgaaaatatatggtttatatatttttaatatataaaaatatattggtttctatatgttaatatatgaaaatgttttatatattttaacatataaatatatattttatatataaacttgtacattaactatatattttatctataaacatatagtttatatataaaaatagtttatatataaaatatgtaaaaatatatgttttatatatctcaatatataaaaatgtataatgtttatatatttctattttcatttatttatttatttttgagtcagagtctcactctgttgcctaggctggagtgtagtggctcgatctcgacttattgcaacctccacctcccagattcaagtgattctcatgcttcagcctcctgagtagctgggatcacaggcgcccaccaccatagctggctaatttttgtacttttaagaaagacagggtttagccatgttgcctaggctggtcttcaactcctgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttataatattttaaatatataaaatacactgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataatttctatatatttatatataatgttttatattttaatatattaagatatgttttatatttattttaatatacaaaaatgttttctatattaaaaatataaagatattttttgaatatgtatgttcaaaaataaataaatgaataaattaaattaaactagaaagactgaaggggaggattgattcaacctaagggttaaaaacatgtctgtggagtcagttggaccactgtttgagtcctacctcttccatttcctagctagatggctttgaacatgtttcataatcttcccataactcggttttatcatatttacaatgggcaaaactactcacctcatattgctggtggaattaaatgaatgcaagtgtggcacatctctaggaatttatctaagtcttttttaaattgattattgtattatacctactataacgacgtgtattttctatgacattttgtgattcaagtacacatattgttactatcgatgatccatgctatttcaaagggttgggcacgttcaggtgacagcattcctgccactcacttgattttgacgaacttccgacatggcacggtgttcctcacacacgtctcggtcagggggtctatgtcttccacgatgacgaatggggcctcctccagggtgacgatgctgagatggttgtcatccggctcacagtcggagaaggacttgtacctgggccacacggcgtgcctcaggctcagcgtatggttctcccacttgcccacctgcagcacaaacacaaagacacagctgtgctttcttccgccgctgatttctggagaggcaaatcctttccctgccagagacatccatccgtctcaagggcctttctgccacatatctcaacatatgcatctacttctgtgctaagacaaacgggcataaagagaaaacagaatatagggcagttctccatcccagccgccctcatccccagaggaatcaacctgcatctctggaggcagtgcccaggcactgatacctttacagccccgcaggtggttctaatgttctgccagagttcaggaccacggatggcaaggaaacagcatagacttttagaatcagagaggtctgggtttgattctcccactgtaccacttactagctgtactaggcaagctcttaatcctaagatcttctgttttctcatctgtataatgaacacaattccccctacttcctaaggatgccatgggaattcaataaagcaatgcatgaaaggcaaaagcacaacataggtactccatattgtttctaagtataaaggagagaaagtgaaaaggagaaagaagaaaaaggtgctaagatgaaggaaaagagaaaaagggagaggaagatgaagctagagagtgaaaagaagaggagtgggggttgagacaacacagagaagagatggagcaggtggggaaattaaaagcatcattttgaccccagatacagttctatttaagttgcaaattaaggtgaacttttattaatcctgcacagaggggagactgtcactgcttagcgtacatcaagacctgtcaaaatagaatcgattgtattccctcggagcagcagtcggcatcttagtgcaatcaaattgaaggctgtatattttgaaccttaattttatttgacagcttattggcgctattcacatacacgctgggaggaagctgcccccgcaccgctctttctcccttctcctcctgctcccacacgccattgcttgacaccacaggtcaccgctttatttgtaataccaacctcgaggaaaacacctcgtgtgaaaagctaagtgccaaatccaggcttgtctgtgttgaccagacccactcacctctcctcctgtaatgtttaagtgtcaccagaaatgaatctcaaacccttaaagagaattcaaacatgccggacaccaggagaggtgacagggtgggaggagagaaaagaatcagtgctctctaagattacctcatcatatgggctggaaaatttttgctggctataaagaaacatttcctgtggctaattacaaaattgtccagcattgctgatacatttctttttaagataggatggcgagtagagcaatttggttaaacacacacacacatgttcatttattcacgctatgatatgtaacaggctggggagaatgctgagcgcatcaaattcttcattcattcgacatagatttattgaagacctacgatgtcccagtgccagcctaggaataatgatggctaaaacagaatgactcttgccttcttggaactgtcagtcagttgtacgacatagatcaaaccaaaaatactgaaatatgcaaatagataaagaaatatacaagtgtttccttttggaacatgttataccaatcccttttctttccatttgccttggaagactcaaacacaaccttcgagagagggtgggtagttcagtgggtaagagaatggcttttgaagtcaaacagaactaagtgtaaatcctggcttcatccactagctgagtagccttgggaaagtcattcaacctctctgagcttcactttctccatttgtaaaatgaagagagcaacagggtatgaccttgaagactgcagtaaggtttgaatgagccaaaaagtaccaaaaatatagagcacaaaacctgacatggcatgtaacacatatggtggctgctattattttactattgttgttaacatttaaaacataactgaactgtcaccttacctgtaaaatcattcctgctttccctagtaatatagaactttgcgcatatctccaccgtagcattttatattataacctcaatgacataacttttgagcactcctgtacagtcaggaaatgtgccaatatcaccacttagtttaattcctacaaactctacatggtaagcattattattccaacttcgtagttcaggaaactgaaacacagagaggttatgtgacttgcacaaactcacacagcaataagtggtggaaccagagttataacgtggggctttctgaacccaaaggtgctttctcgctatgtacagtgtttctgtgaattgagctacagtaaccacgttatagctccaacactcttccttccttgcagacatgtttcctaaagtcccaagataatgtaaattaaggcaaagactagcagaatctttggtgatgtcattgaccacatcacaacccccacaccatgggagtcaggcaaaagtttcagtccaacgctcgctcatggagagaaaagttgcaaaggtttatgagcccccagagtgcaataacttcctaaatcttctccaagttctactccctgttcctgacacatccaagtatccatgggtcagccaaggaggttgaagatgagtggtaggtagagagaactcgatcaggagctgaagctgctgtgtcaacactgccctaggtcccaagagctcttaccttcttttctcatctgatagacccttcggcaccccactgcaaacaccaaaaatctcaactactaaatcgtatataccagataaaggagaacagacattcttcactttccctgcctatattcctatttacaagggactataactgaggccagtgtttgtagacaggtttagcagagtcattcattccataaatatgtgttgagtggttactaggttccaagcactgtgctagacactgagaatactgtaatggaagtgataaaatgtttgcttgcatgaaatttttgtgctaattgagaagacacatgagtcaaatgattacacaaaaacatatgttcatacaaattgggaggaagaaatgaaacatgggtctaagagagcatataggagaaaagatatcagagacatcttccctgaggaggtgacacttaagctgaaattggaaattcaggatgagttgcatcgtggcagttgtgggaaggaattgtggaggagcagagaaggaaagagcactccagataggtggagaccagaaaatgcaaagccttgtaggctctattaagaagttgggatttaccttaagggtttgctacagactgaatatttgcgtccctccaaaattcataggttgaaatcctaacccctaatgtggtggtgttaggaggaggggtctttgggagctgattaggtcatgaaggtggagccctcatgaatggggttagtgcttttatgaaagaggccccagagagacccattgccttttccaccatatcagtatgcaacaagaagattgctgtctatgaaccaggaagcagctctcaccagacgctaaatctgctggcaccttgatttggacttcccagtctccagaagcatgagaaacaagtttctgtggtttataagccacccagtctatggtattctgttacagcaacccaaatggactaagagtcaatcaagttcaatggccagaatggaaaaagatttatagaagtcaccatggatatatgtccatatataacctgcctgaagatggaagcttctttgcctactccaatttttttttaattatggaaatgttcaaatgtatttaagagtagaatcatataatgaacctccgtattcccaatgtccagcttcaataattagtactcatgaccaatcttgtttcatttatactcccactcactccttctatattacagcaaaaaaacccattatataatttattcataaatccttaatttgatttaaatatctaaacatcatttgcttcacaatattatacctcaataatctacaataatctatgtgtttatgtatatgttttacttatgagactatgatttcccagtctaccaggaattttatatgcgtaatgattggtttctatgtccacagcttctaactcagggcatgccacatggagggacttaatgggtagtttttggtggagtgaataaacatacagcctgtattttttacatgtgcatgagtcagaaagtgttagaatgattaatgtgtccatatgtgcctcagctttggaatcttgtaccctaggcaaaatatggaagtatcaaggacctgtattctctcccttgctcttactgcaacttcagcccccgagactcagagccattgagggtggccgtctgaatagcctttgggtattaaatttccccagagaaagcaaacagcatcatcctaacaccattttaaaaagggactccagccaccagagtattcagggagaaagaaagaaccaatgggttgaatcctgaagacctcagtttcgactgtcatattgtttctgcttgtctccatttccacagtggcatggagtatgtatgctccaaatgcctttatttagaagttatatccaaaatggaaggaccctgtgcactttgaagatggcagccaaaaatatctctgctcccaccttggacgtgatggtgactcttctgctattctctaaactggacctttttcctgttcccaatcctctccataaaagtgaacaccacactcagctgagtctgtaactttagatcagcattcctgactcataaaagctattctgaagtgtgagccaataccagggttgcaccgcatttcctccagcagtgcttccaggagtaaggtttcaatccatttcctccagcagtgcttccaggaataaggtttcaatgcatcagagcaagtgaaatcatacagtccttgtcaatcacatgctatttttggagcttggagggaaaatgaagttccaggacaccttgccaaacttctggttatatttatacacaaccaggacaggcaagcacgcttgtgtgtgtgtgtgtgtgtgtgtgtgtgtgtgtgctgtatacatgtacatgtatatgcacatatggatcccattgagttttcaggcatcaacttcattgctacagaacccctctcttctctcctttacatggcacaggacaagagggttcagaatcattaatagcacaggcttagagatcagacagatgaacaggttcaaatcttgtcactgctttagccatgtgaccttgaacaagccacataatctttttgaacctcagttcactcaatcaccaaataaaaacaacacttccatttcatatgctgttatgaggcttacttataagataataacaacaaacatctcttaatgcacagttcctggcacacagaaaggtctccatacgtggaactattatcattaattcaacatttgttaaacttatcttcaggaaaatgagcctctgtagcagaagaactaattgacaaatggagatctgagtttcttcaatggcattcccttgacttttgacctcactgattgggtgtcattctcctcactgtaacaggaatgaggggagtgggtttgaatcagataatctctaaggtctttcaggtatagcactctatgtaaaatgcaaggataagctgccctcccaaatctttcctgatttgagctcagggtaatgagtacataattagaagaggggcaaaggtggcactccttacttgacatttaattctgtatggcaaccatatattagggcagtcttgcacccagggtgaaaggacagcagaaaacagccaaatggcaagctatctctaaaaaaggtggcaggatggttctgagaaccagttagaagactgaggaaagaagaacatggtcaatagagccctcttggatagtaattctccatgctgcacaaaaaacagtggtactcaaatctgaggcttttctcaaagctggctcttcctcattctctaaagaagggcatgagttcaaatcctgacttgtccattcctagctggggcacagtgggcaataatgacaaagaccattgttaacactgattagggctttactatgtgtttccaggagcagtgctaagggtttttcattcattatatgactcaatcctcaaggcaactgtaggacatagataactataattatcctcattgcatgatgaggaaaccagggcttaaaaatattatgtttcttgctcaggtcagatcataaggctcacagtaagaatttaaacttagtcagtgaaaacctctagagcacagcttaatcactacctccctttttgaaatttagtttcttcatattttaaaggttacaacaaggccacagagttgttataaagattacataagattcacgcctgtaatcccagcactttgggaggctgaggcgggtagatcacgaggtcaggagatcgagaccatcctggctaacatggtgaaaccccgtctctactaaaaaaaaaatacaaaaaatttgccgggcatggtggtaggctcctgtagtcccagctacttgggaggctgaggcaggagaatggcatgaacccgggaggccgagcttgcagtgagccgagatcgcgccactgcactccagcctgggtgacagagtgagactccatctcaaaaaaaaaaaaaaaaaaagattacatgagatgataaaaataagtctttccgtttctactattccgaaagctttaataatttctgtaatcctaaaaatagatacatgaataacatgctacttttattatctccatttcatagatgaggaaactgaggcatggggtttaagtaattgtccaattcatatggcagaaccaggatgtgaacccaggactcatttttaagtctgtgaaaaaatgcaactagaattttctgctgaacaaaaaaaaaagactaactttacaatgcagaaatgtgacagatgtgatgtcagctcaatggtcaaagccaatatggacaatgataaatcattctaatagtacatatccttaatatgatgtgatgataatggcgtggtgttctacctgtgtcgtcttataacctcggtgtaattataagaaaactatcagaaaaattccaatgtaggggtattctagaagatatctgaccagtagtcctccaaattgtcaaaggtcattaaaaaacaagaaggtctaagaaagtgtcctagtcaagaggagcctaaggcaatattacaattacatgtcatataggatcctggatcagctatcaggatggaacagaaaaagattagataaaaactaaggaaatctgaaaaaatcatgggttttagttgacaataatatacgaattgactcattatgacaaatataccatactaatgtcaggtgttaataatcagagaaactgggcattaggtatgtgagaagtcactggactatctttgcaagttttttgtaaatataaaactagttaacctaaaaagtttattcaaaaactgtttttgaattcaaaagggagagttttttaaaaacagcaaatatgttctcagacacagagtagcaaagttgccaggagtttaaactttggagccagccactctggcttcaaatcccagctgtaccacttgtgagctgtgccacttgggcaaatttcttaatatctatttgcctcagtttcatcacctgaaaagtaggatgatgttaatagtataattcacaggattgctgagaggactaaattaatgtattaaagcccataaaggaatgcccaatgctatgtgctatgtattgctattttgtcattgtttaaatcaatggggaaacaattttagagtagaatttagattatttcatgttttaacttcataagagcttttctcgatactaactttagtttaatttagacacagtttttaccatgtcagtagttttagccataaatcacgcttttctccacatttctcccaagggtttcacaatagccttatgctgttttgcttacctgtcattcatttatcagatttttggttatagcatattcattttcccttggagagatgctgccctaatttaacgaataggcacgtgtcctttatttggcaaatcagtacactgactggctcaggaatgtgcatgtgacctaagctaagccaatgagagttttccctgggacttttgatggaactatcagaacagggcagtcatgagagaacaacttatcagaaaataaatactggctaagaaattgagagaagaaagcaataaagtggggatggcattgcttgagttcttataataacagtaaaaattgacattcactaggcacttattatgtatcaggcaccattcttagtgctattttaattctaataaactccctatacggaagaggaagttagggaaatacttttttatctctattatgaatttttttggtacttaaaagcagttctcaattcaacaaaataggttgtgtgggaggagaaaaaaaatctttacctttaaaataaactgaattttggtgataagcctttgagtgttttcagaaatatactgaagttgtgacgacaaaaataataataataataattgaccgctgatggagaaaagtgattttgctaaaagaaatataaaaagggtagattaactttgtaatgatgtttaattcctattaataaaatttaaatacagtgcttttaggaaactaattgctcttcagctcctagaaagattttttttaaagggcagtgattacttatcaaaatgttcagccaatatgttcttagagcagagataatttcatctccagaaattgtatgtctcaagttaatatacacctcttatgtccggataaattcagagggatgttgccaaggctgcaaaaggctggaagaaattaggttaatagatgtgcgtggctctttcaaagagatctgagtgttttatcttatttgatctatttatgaaatgcttacaagagacaattaaaataacctcatcacaggtctcctggtctctgaagccacctcctaaaaaacaaatatctaaacaccaaaattatagatctactccatgctcaagtccctccatgtctcatgctgcctacaaaatcaaatccagactgctctgtatagtaaaagctcttctataatacaggcccaatcaacctcactattctctttttctcactttctctctctcattctcacacacatcgtcacactaacacacacacacatctgcctttgcacacacacttatacctacacatattcacaattaaacatggaaaaattcataatagagataaaaagtatttcccaaacttcctcttgtgtataggaagtttattacaattaaaatagcactaaaaaccgtgcatacataagtgtctgatacataagtgtccagtgaatgtcagtttttactattataagaactcaagcaataccatcagtacacctacacatatatgtatacatattcctatacatctatacatgaacctctacataaaagcacacttatatacaggtacattcatgcctacccacgctcacattataatcacatacgctcacacccacacgtacaactacaaatacacacatacctaacacaaacacatatactcgaacctctacacacacacacacacacacacacacacacacacagagaggatatgaagctacaatgatgcatacacttttcacaaaacacaccctgaacgacacccactttcctgcctatgcctacactatttcttctgcctggaattcttctccttattatctccccctactgaaatcctacccactcttttcaggcctagctcaaatgccaatactcccatggaacctaattctccatctggaattcatttttgcattttctttgcctttagaacacactttcccctcacttgtttattcatgagcccacatgccttcagtgctttccactgtgccgggtaatactggaagccctggggctacggtggtgaacagtcctcagagaggtctatcctatccctagagtttccagtctcggtggagagaagtcaaagcttaatagcaatgaagtgaatgaagtgagacaaatgctatgccgggagcaggcacaggatgctgttgaagaacacagcttcctaatctggaagagaatccaaaaaatgcttctaacaggaagtggcttccaaatatgaaacaggcatggtggctcgcgcctgtaatcccagcacttcgggaagctgaggtgggcagatccctcgagatcaggagttccagatcagcctggccaacatggtgaaaccccatctgtactaaaaatacaaaaattagccaggcatgggtctgtaatcccagctactcgggaagttgaggcatgagaatcacttgaacccaggaggcggaggttgcagtgagctgagattgcaccactgcactccagcctgggtgacagagcaagagtctctcaaaaaaaaaaaaaaaaaaaaaaaaagaaagaccaagggagttagtaggttgcctgttatggggttttatctttatcctatgggcaagtgacatatgtaagggatggggatgaggacttactgaagaccttactgaaatcaatcccccaattagaagtggattaaacacttcttctcaatgtagtgcagagatagagtttgtagctagaagattcggaaggcagagtgacaagctgggagatggctgcaggatctggatgacacaggccatgatggtcaggctggtgtgaactcaaagtgtaaaatcaacagaaaagagatgggctgtaggggtggggaatgagggcccagtttgcctcgaattatggttttgtagagtgtcatggctggccagtcttcctcaaccacgtgatccatgttcgatatagtatagtgctcacccacaatgcagttcaagaagtatccgctgaactgaattcaattctgactgtagcatatcatccatttttacttacaattcagagtttaaaaagggaagttgcctgtttactcatcttctctccttggagacaagacaatagaaattgcaaaactaaaaatcagacaggaaatttattaaaaccaacaacagaagcagagttcaggctgcctgtgctctagtctggctggacccagttagctcattgggtggtttcataaccatggggaaacaggctttaaaacaaacacattgagcttgcaaaccttcggagtatgtttcactccagaaaataagcagtgatttactcccaagctggagaaaacatgagtaattaactcttcaggaagatgatgttaaggaggaaaaacaaagcaaacgggagaccaatttctctccacctgaaatataaagtctgccaaaggacatgagataaatggccgtgaaggaaatttaaaatgatttagtgtccatatttatcataagtagcaacatggattagcatcacttccatgccgctgaatgcacatctgacacacaaacaaaccgatcacaggttaacacataagtaattctgggtcttgggttgctgcttgaaaccaaaagcagatctaaatgtaattgatccagaaacaacaataaagatatctgagccactgctgtggcttgatattaggttgacatatgctgtatctggaggactttgcagttgagttcagtgatgttttttaaaccaatacctgatctaaagagtatcccagaaaaccagtctgctgaaatcaagcgtcactttggaactcaattttcccctgtgtggtatgcacaaacaagtttctatgcagaaattactaaagagcaggtgtgggtcaaacctgctctgtcttcactgccatgagccttggatggctaccggcagagtgaaactaagaactgcttttcagatattgaggtaaagtgcctgcttcctctgaatgcactgttttaaatgcaacgattggaggtggtgggattatgaagctttggcatgaataagaacctttcctggaagctgattaagaatgcagactcctgtatctctggagtgttggaatcagtagatctgggataaggtgtgggatcctgacttttcaaccagcgtcctagagtcattctgctccgtgtggtctaaggaccccattttaaggagcaccaggaggggaagacctatgactaacatacaggattaaataaagcataagaacaagatggaaatctttcttcttgggttacttatgtaaccactggcaattgccagcagatctaaatgagtttaatcagctattagagccttaattaaattcctctcagttgaaatttcagaattgcctaattgttacacagctcacattggagaagtagattttttttcctctcgtaataactgctctcaagataatctagtatctttatggataacagcatcaactgtcttagaacccagtactgatctggtaattcatagaaacgtgttttgattgttatttccatgaacaacccgcatctctgcttccattctcctcttgaggctcagccaacaggggaagagctcaatgcttgttcaatctcaaatttaaaagcggaaaaatctttggaacaaagagccatcattttcttcaggagttcatgtataatcttcagtcctccagagttcctttgttgccagatccctggggaaagataggagtcctatttctttggattacttttaattctttgtgtgctcttaaaagtgatgggttcttgtaattagctaaaaagttaatagtgttttctctcttttggttctaccttggagtaatataatgccagagacttgaaaaatcagcaaaaataaaaaaggagctctttcataatcatggattaattttttgaacttgctcttgggagtccttcattgtgcaagttccgtatcagtccgtcttccatgggctgcaataataattattaaacaattaacgagtataattgttggcatttattgaggtactgtgatcaccccaacgggcattttctattttaccctcacaatcctctgataaaaacgccattattagactcgttttgtatgttggcaaacagggaatttaagtgacttgcccaagatcaaacagcaagtgagaagacctggaatctgagcttggacttcagggcaggagctgttaccactgcctgatatttccaaggctgccatcctatttgctttgggaaatattaaggcaaacatgagcagtttggtttcttaagggaatatttcatggatcagttgggaagacagtattaataattagcaccatgcagcacagtgatgtcctgagagttggagaagccaggttctcgccccaatatgcacagtcttccactttgggaaggggcaacattttctttccatgtggagcacaggaggtggggagaaagcagccagaggtggtcttacagtgtgcttttactcatgacagttttacttcttccatttgcctgtgaattgactcttctgaggaccttgaattccaccacagaaaatacctctaacagcagagctgcactgagctctactttgcaggcttgatgttgaattccactgctaccaacacggacatccaaaaggcgatcagaacagcagatcaggcagagaaaatcaactgttcaaatgtgaaccatgtgtcaattaggtaatttgggggtttcaaccaagaggaatgtcattaatgctctagcagctgattggacttctcccttgcctctgtggtcatctccatccattatgtaaggggccttagaaaggaggatttcatcttcattctgtatcatgttatatttgagatattgttggccaacacaacacaattctgtttctatatctgcatctgttattataaaaacccaaacataaacttggttgaacttaaggggctgcttcttggaggagaaaactagaatgcatataggtctgcaaaaaaagtttaggaggagatgtgaaggtaactaggacaatcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagttttttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaatgcatcaaacctgacttgaaggatctaacaagtcaaaagctgatggatttcctcactcagcattatgtaaaaagccaattccatttggatctcagccctgaacattcaaagttaacctcattgactgtgtctgcagagttttgcaataaggttacagaacctggaggtatcaatcagtggaacagcatttcatccccctcgcctgtgaaaagttattgcgttgtgagaggtgaaatgtctggaacttggtagcaggtctctgatgggcatttgttcttctgtatctggggcaaaataataaatttaagtttttgagatggacattttccttcttccaaatgaaaggggttggtgcctgaggccctgctagttattatgaggatgctaaccaaagccgttgtgcatgggtgaaatgcatcgttatgatgaaatgcacactgatgagaatttcaattttccttagataagatggtattttgacaatcatttttctttgctcatctctggcccaaaactactttgctccaggcttgtctgagctctaaagtattccaacaagaggatcatttgaaatactaaagccaacagaagatttaatagtgagaaaacagtaataagcttaacgacagctttgcccagttaaaaacgtgattattctaaggcactgggggaagaggagggttcccttgggatgggatggataagacttgctgtttttgaaaactaagcctaagtaacccaccaccgtcaatccaatttcacccaaaccaattatccccatctcagacagtaatcaacaatttgagagccctatggagccactgggagaaatgagaatcatggtgaccaatcaggaagcctctcagcattgcttttcccactgaattattaatatagtggcaaacacagcagtttaaaagaaccgtgcatttggagttggaagacccaagtccaagttcaactatgatacttatgagctatgtcacatcaaaacctttcaaactcacacaaattatagccaaaagcagaatctcaggattcctaattactccaagtgttacaaccaataaacagaactattctgtaggttttcagttccttagggttagatcacatgcattcatcttgctcattcattcatggagtgcctactatgtgccataaactgttctcacactggtaacacagcagtgaatagaccctaaacctggggtcagcataccacagcccaagggcaagctgtttctgcacagcccacaagctaagaatgggttttccttttccatttttaaatggttgaaaaaaatgaaaagaatatttggtgacacaattataaaattatataagatttgaatgtgagtgtccctaaataaagcttgattggaacacagccatgcttatttccttacatagcctcaacgcttgcctttgcactaaaaatgcagagttgagtgcttgccatagagagagtatggcccacaaagcctaaaatatttactagccagccctttacataaacagttaggggttttgtcaacccctgctctaagtccttatctgtaaaggatccactcaccagtgaggaagataaaatacaatgccctctgaattaatcatacaataaaacagaaaatgctaacagccaaagggtgaaaggtgcaagaaatgcagagggcttcagaagtgagaggcagatctgatgagggaaggaagaaatcatgaaggagtgcaatggaggggagttgtgcagtttgcaaaggacctgaaaagtcagagtggaaagaagggatgtgtaggatcagagaacagcatgcacaaaagcttagaagctgagttttaatgacatgtttgtgaactaggaagttgtccaaacaggaagaaacacaaatatataaaggagaagagagggaaagaggaataaagggataccatgggacaagactgaagaagcccttggatattgggctacaatccctttgtgcacattggaatttggttgcatttaagttgaaattggcaattggccttgggaaatccctctgactcaacacctggggataatattggtgatttcatccacatatggctaggacttagtactccttacatattttgaaattgtcctatttgcaagtaattgatgtcatttcataaacacatccatacttgtcagagcatttggataaaactgaaggccagtttttttgaccatctctccactgaccacctccagtccactgtagccacccattcctatgggtgaaattcacttagaactgcttgacttgagtgactctaaatttagaacctccagtccactgtagccacccattcccatgggggaaattcacttagaactgcttgactcaaatgactctgaattcagaaaatccacagctctcattcaggtattcttatgtctcctctccagcgtcatccctggtctctatcttctctcaattagtctatttgttcatgccttcatttcttcccgattccaacttagacctctttatccataacattaacagatttcttgtcatacccacaattttcctgcccccactttgtcttcctatcacacccacctggcagcaccctccccaactctgagtcaatcccaccacttccacacctgtaaagcagcaagtacaggtggagaatatcatataaccacatagattaatgtcatttcaaattttaggactccctctctggctaaaaatctttcctttttcctaattgcatctctcccattccctagaaactatttcaaaccttcacacctgcccacaagactgcaaagctgccagctccagccccactcccagctgatgaatctgcctcttatttcagactctatggacaacccacatcacccacaaactcacctgcctctgcacacatgtctttcttctcccctctttcagtaataaaggaggcatctctcctctagcctaacacgcatcccagcccttgggctctagatacattctcttctgcactgtccttgcctctcaaactgacctaagacctccagtggttttcactaaatccaacaggtgcactgcacataagcccctcctctgcatttgacaatgggactactcacatctttcttgagttctctgccctagactgtcaggacactaccattacccaactgtttcccacctcgttggctgattcatctctgccaaaatgcaagcttctccttctctgaacacatctgacttgtctttcctctccctcttgcccccagaacatccaggctcaggcctcggcctcttctgctccacagtctccagttatcacctctcttgacagcccctgatctgctgcctttcccccattcttctctactgcctccgagaaacctcaaactcagtaggcttagagaagaactcagcctcttatcttccaccgtaaaaaatagtttctctcccatctgccatataggagttcttgaaatcccaaccatggaaatatccattaattcatctctcttctgccacccccatatatattaaatcaatcaccaagccttgatagttctaatatttgaacattttttactgctttcctaactcacagccaccaccctcatccaggccttcacctctcactggtttatgactcagcttcttagctggccttcttgcttctggtagatttgctcttcatcccattctccaaacagcagcccaaaccatcactttattttttatttttttgagacagggtcttattctgtctcccacgctggatgcagtggcactatctcagttcactgcaacctccgcctcccgggttcgagcgattcttatgcctcagcctcccaagtagctgggattacaagtgcgcactaccacacctgggtaatttttgtatttttagtagagatggggttttgccatgttagccacactggcctcaaactcctgacctcaggtgatctgcctgcctcaacctcccaaagtggtgggattacaggcatgagccaccgtgcctagcccaaatcgtcactttaaatacctctgtgtatctggcccttccactccccagcttgtggccttttaatggttccccactgcagctggaatcaagtgaaaatgcctgaccatggtctaagtgacctggcctcctccccaggccttcccttccctctgcattcatgacagcctcattttgacaaccaactcctggttccagccctgccccacatcaactcatgaatcacacagaactaatcacaggcttctgagtacattgagcttttctctcagtgccaggtttcaacacgctactcaccctgcccagaaaaccccttcccactctctgcctggcactctcctatgtgtccttcagaactcaacacagagggcagctgttctgggaagcagcctctaatcccataaaactgggcaggtagcctctcctttccctacctcactagctagtgtgagacctgcacactcatctgtctgccccagtggactcattgagggtgggactgtgttctgtttgcctttatggccctcgtacccagcccagggctgcttacataatagatgcacaaatacctatgaaatgaacaagttagccaggagcggtggctcacatctgcaatctcagcactttgaaggcaaggcaggaggatcacttgaggccaggagtttgagaccagcccgggcaacatggcaaaactctgtctctactaaaaatacaaaaattagctgagtgtggtggtacatgcctgtaatctcagctactcgggaggctgaggcatgagaatcactttaacccgagaggaagaggttgcaatgagcctaaatcacaccaatgcactccagcctgggcaacagagcaagactctgtctctaaataaataaaacagacaagttagcacacagaggtaccaacatgaccaccataactatgatcttcctgcagtcaattatcaactataattatctcttctggtaataggccctgaaaatgatgtggattttggagtcagccacatctggacctgaattcccagctcttctgcttaccagctatatgaacttgactaactttacttcttggacatcagtttccttatatgtaatgtgggcataataggagtaatcacatcatattattctcatggaaataaataaagtagtaactgcaaggcacttattgaactatctgccacatagtccctgctcaaccaggattaggtgttttattatatacagggatcttagaaggatgacattaactcatgtttgtgaaccagcagtcagatgtctggcccacagaaggtatttagtcaaggttccttcccacctgcaatgtgcatgttcttgtaagctgaatggaggacactggcacaactccagaacaggcaggaacaaggcattgtttttaccaaaattccaggcctagggcttgtatgccaaaatgaaactaaggaaatgtatttggattttttttccctgctctaagaggagacagatctgcttttcacttacggctctctattttggatagaaaaaatatcatctgttaatataattctgtgcacggagaaggcggtcctgccaaaagccacttggtgttattttcactctaccaataaatccaaaggcctggcaattatttttaattccatttgctagtttgaggttctgcacgattaatgcatgccattaatttcataactataaatgtaacccaagctttcttggatccttgtgtcaaacagtgtgaccttatgcatacacttgctagtgttcacttggctaagaagctgtattggggaaaaaatgaaaagaaatagaaaaaaaaagatagaaatttcagataatagacacactggaagacacatcctagccagaaagctgcgtgtcattatgtggataataatacaaaagtcctagagttaatatagctctttatgggctagaagttgctggttattttctcatttcacttgaccatcacagcagagtcacatagatgtgaaagagatattattacaatttttcagagcggtaaactgatgttccttcaagtaactttttttcttttttttttttttttctttttttgtagagatggagtctcgctctgttgcccaaggtggagtgcagtggcatgatcttggctcaccgcaacctccgcttcccaggttcaagcaattctcctgcctcagcctcctgagtagctgaaactacaggcacacactgccatgcctggctaattttttgtattttagtagagacagggtttcactgtgttgcccaggttggtctcgaactcctgagctcaggcaattcaccctcctcggcctccctaagtgctaggattataggcatgagccaccacgcctggctcaagtaactttcaaatttaaggactattctcatgtctcttttccaatgtcattttggcctctgggctctggacccctctattttctcccaatcaatctgctcattcgtgactttccattttttccctattacagcccagatctctttatcacagcaacagatttcctgccacgcccacaattttcctgctcccatcttgtcctcctgtcacacccacctggcaccaccttccacccagctctgagtcaatccaccacttcctcacctgtcaaccaccaagcctcattcacaaattacagcaaatatgtgaaagaaccagaaacagttttctggctcctggatgaggacttgcttaactgtatgtattgcaatatattcatacatatgcaggacttaaaggactccttgaagacacttgtctctaaaactttggacccaggtcctttgataaaagagaacactgtcaatagacttttagaaatccactgaaaatgaaaaaaaaaaaaaaaggtaaaacaaccctaaaagtgccatttaaaagtctagaagtctagagtctagattgcactttgtatatgcataatagttcctgtttattaagatctttctaactacgttccaggcctcatgctagatacttggcatgtatatcatttatgatgcctctgagctatgaagtggctgggtgaccatgttccaatcaattcacttctctggtcctcatttttctcatctataaaataatatgtaccatttggggttgtagtgaacataaaatgtggtaatgtacataaagtggttggctcaggacctgtgatggaatcacagtttaaaaactattaggcactttttttttggaatgatgcaaggaaaactaagctccattcgcttcccacttaaattctctatctcccacagcatggcacaattgcacttgctttgtagaatttgattgaagaaagtagcagaagttagtagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgggagtctcacaaatgttacccctggccaaactcaacagcgtaaatgttgatcaaactcgctctctaaccccaaacagctcagctcctaaccggtgccatgctcagtgaaacaggggaggaagtcgccagcccacttttcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttgaatcctcatccattttcagtgagatgacaatgcctcaatgcaaagcctccatgtcattttggtaatgaaactcaaatcttcgggtaaagaaaatgtggtatatatacacaatgaaatactatttagccataaaaaagaatccaatcacgtcttttgcagcaacatggatggaactggaggccatgatcataagtgaagcaactcagacacagagagacaaatactaggacagatgtggtggctcacgcttttaatcccagcacttagagaggccaagtggaggggtgggggaatcacctgagctcaggagtttgagactagcctgagtaacatggcgaaaccctatctctacaaaaacaaaacaaaataaaaacaaaaaaactagccaggcatggtggcacttgcctatagttccagctacttgtggggctgaggtgggaagatcacttgagcccaagagttcgaggctgcaatgagccatgattgcaccactattctccagcctgggcaacaaagcaagaccctgtgtcaggtgttagaaaaaagaaagaatgaaagaaaaagaaataaggacaaatactgcatgttctcacttgtaagtgggagctaaataatgcatacagttagatgcagaatgtgtaatgatagacaatggagactcagaaaggcaagtgggtgtgagggaggaggctgagggaagaggctgaagagaagctacttaatggatacaatgtatgttatttgtgagagggatactcaaaaagccctgacatcaccactatacaatctatgcatgtaacaaaattacacttgtataccccatacatttaaacaaacaaaaaaagaaacccaaatcttgctgtattgattcaagtcaccaacctgaatgccaaaagtggaatgagactgggtgcagtggctcatgcctgtaatcccagcactttgggaggctgaggcaggagaatcccttgagctcaggagtttgagaccagcctgagaaacaaagtgagacaccccccatctctaaaaaacaacaacaacaacaacaacaaacaaacaaacagaaaagaaacatctgtggaatctttcctggtcttagagaaaacaaaacaaaaaagtggagtgaaatgtttactattcttgcagaagaaggctgaacaagtctcgtctctaaatcttagtctcttcacctattaaaagcaggtaaatgtttctgctttccctgtatacagcatggatgtcaggatctgatacccaaaactaattgttgccctgctttcctatgttagatctgcctgtcctagtttcttcaaacacactttaattgtggaaagaaaacatatgccatcagctataatctgctggaccacatagaggccagcacggtaggaatcaacaggaattaggattcttccgattcaaattgtttgtttcaatgttaaagttaaagacaacgtaagtgagaggccattggtttctatgagtcattctacaactccctttaagggaatacgagttgattctcttgtttttccccaactttagatttttttctcatgggcatttccaacggagtctttcttcacatccagggaagtcaagatggctcagcctctactcttcccatctcaaacaggcccactcagtctttctaatttgcagaattataatttaaatggaaggaatatagactccaggaatatgatttcgatgagttttaaagcacgttttcaaaagacaatggctagataacaaaccatacggtggagtaataaggaataaaggaacagtttactgcaggggtggggactgatttacagcttcagatgtgcagaggaatgctgattcgttttgcacaaaaatgcaagagactgattaggaggcagatttgcatacatctcagtgggatgctctgagccgagctcagaaacagacatgtggttcagcagggaatcttgtacctgtaatagtccttcttgccaacgctgggggcacatccactgtgcagggatggggggacccccaacatgagtttttataattaaagcactgacagccttcactactgatatatgaacgccacccatctctaccataaggtactgtagaaacaaaatggactttgcagtctagcagacctgagctagaatctagactttgccatatacttgctttgtaaccttaggcaaatcagcaatcatcttagagcctcagtttcttcatatgtaactggagggagggggcaggagtgatcatactcatcttgaatgtctgttaaaagaggatcaaggctgggcacggtagctcatgcctgtaatcccagcacttcaggaggccaaggcaggcagattgcctgggctcaggaatttgagaccagcctgggcaatctagcaaaaccctgtctctacaaaacatacaaaaaaattaggcaggtgtggtggcacacacctgtagtcccagctacttgaggggcagaggctggataattgctcaagcccaggaggtagaggcctgcagtgagccactccagggagtgcagcggcatgaacatggctcgctgtggccttgacctatgggctcaagcaattatcttgcctcagtccccacaagtagctgggactacaggtggctcctcactgcagcctctcgtctcttaaaaaagggtgtgtgggggaatcaaagtggtgaatctatagcccctaggccataatcatcatcatattttttttataacatatgggtaattatctcaaggtacaagttcttcagagtctagaaagcacattaaatcctccacagcttagagaccaatgctgagaatatgcaacctctttttatctctatttctccccctgttccaaaccaggttccaatgccaagaaaaacagggtagtggaatgggaagcttctgctgccaatggcacagatgaggaaaccaaactgtagctacagaggcaggctgacagagccacttgtagccagaagcagattgctggggggagcagctctctgttctgtccattttcttagggacagatgttattcctgtctgttccatcagcaggcaaatggggaaataatagaacagagacaatggaaagaaagtgagaagcaggcccagacagcagccactgagctccagtaattgtgggtggggtaggggagaaatctagctgctgctatcagatgcaatgtgaaataaagaaaaataatgtttgtggttcagttactagaatggataagatgactgtcaccctttggatagctcttctttatcctttaggacttggtcctaacttaggtctttcaggaagttttttcacctccccagtgcccaggctggagtaggtgtcccagtgtgccatgtgcacctctcctgtttatgctcatttcacaatgctgtaactagcagtgcatttccctgtccctcccactacattataagttccctgttggtagaagagctgaggcaggactagcttctctgtcataatgtaaaagagtcttggaacgtgtcctgggcccaggctctaaaccccctcatggcctttggaacaccaagctctgtgccaaagggtggaaggctgccctgccacaccacaatctaagcccagggcataaaacccctcgtggcttggatacaatccaaggctcagggcataaaatcccttgtggaattgcactggaatggcctctggaatgtgcacagacttgctggctccttgcttcttactctcccaggcttgtaaatatgttctccattatctcaggtagcagagcatattacatatgtgtcaaagaaaatgctaaaccatcacagctatgcttgatgcactgctacctttctacccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctactacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtcatacccccaacttccactcaacttccaaggcagataccatccctgtgaatctccacaacctatatgaaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgcggctaaagtgaaataataagtacagaaggccatactgtaaggtttggtatagaataggtgctcaacaaatgcttactatttatttacgtcatattcagacaactactacagtcaatctccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctgaaaggaatcagcattcaagggaatataattagaaaagaaaatttgccttaaagtccactgttactttgttctctctctctcgtctcctcttcccccttctctctcccccttcctctccccagttccgtcttcctctctccctctcccccctctctctccccttcttcccctctctcttccccctcttcaggccctctctatctcttccactccctctcccacctctctgcctctccctctcttctccctctctcctcttttctccccctcccgctctcactctcccccttactctttccctctccccccatcccccctccctgtcctgctatccctccctagccctctccctgcctccctctcccccaactctctctctcctgctttccccgcttcctcagggctttgcgtttctctacaacacagatgagcagatgaccctgtcagaaaaccaaaatggttttcattggtctattcaggagtttctagaaatacttctgactgagaggctctttgaataatttactcatctgagatcatttaaataatctatttgctcattttcataattgatggcaatggaaaactagcaagggtgcagcttttgtcttacatttataccacctgtcagcttaatcatgctcccatcaccctcagagagatccttaacaatttgggtttgcgactgggatggagaagaatgttccatatgaccgaatgtttgactctggctctattaaaatactgcttgggctcaagtcctgcctttaccactgtatggccttggacaagtcattcaacccatgttgcttccaatttctctcctataacatgaggatagaaataattatacttagaactggcatctatgtgtcagtgttctaagcacctgatatatcaccttgtttaattatcctaacaacctaggaggtcagtactattatggcctcccttttagatatgagaaaatgcagagaatgttgggagactgaaacaagattatccattgaaaacactctgcatggtgtctgacacacagtgggaactcaactaatggtagctgctgccctcatgatcatcccatccatcaagaacatcaccgtcatcaccatcatcatcaatcatctttatcattagtatccctatcaacgtatgttcccatagagatgtcttttctatgaactgcatttttttttgttttaagttctgaaatctgaaaaactttcagcagaatgttgctctgcaggagagcgcctgttcaactgctgttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgtgacctaacatattgtactgtgtgagtatttaaaatagtcactatgcgtgactctagggaagtcagatgattattttattttatttatattcacctttgctaaatcctgatgcacagatgataattttaaatgttttataatggctcaattttccctctctatggctcacatcatttgagaaacttaacgatcattatataaggaaacaaattaaattccacacagactctgctaaggttgatattaccaaacccattttataaaaaggaacttgactttaaatatggatttgggagaagaaagaaaagaagagaagaaaggaaggaggatgacagggaaggatgagagatgaacaatgtcatttacaggcatggcaaagctcttccagaaatacctaatctgaaaatacctaattagagacttacacctaaaaaaaaatttttttaatctatctaattcccctctgtcatgcatctgccagagaatcagtgcagccaatgccatggctttcagttctgtttctgaaatttctctcagattccgcggccactattcctccccatacctctcttccctctaacccaagccacgtaaataggcccttaaaaaatttcccagattcttgacaatcaccattttccttttaaagaagcagtgtagctcatgtctaagagtgcagacaattgggttccaaatcctggctttgaaatttactagctctgtgactctgagcaagttattgaatttctctgagcctcattccctccatttgcaaaagagggtaatagttgtatctgtattacagtcctgatatgaggattaaatgtatgcttaaaacctaataaatgttaaacaaatgtgagtgatgattattttttatgttgttctctcatctcaagctcttcaatagtgccctgaagattactgaattaagtgccataacctatcatttaaattctagcatagtcctttacccccataaagtttccttcaaaagatttgtactagtctgttgttgtgtagcaaattacctcaaacttacccatttgaaacaacacctgtttatgatctcacagttctgcaggtcagaagtcccagcgggctcagctgggtttttgctcagggtgtcacaaggccaaaatcatggcactacccaggctgggctcatatctggaggatcttggaagaatccacttccaagctcactcagattgttgggcaagctcacctccttggggttatatgtctgaggtcagctagggactgacagtgcctagaggcccctgcattccttatcatggagccccctcgatcctcaaatgtagaagtcagactaagcattctcacactccaaatttctttctgcaactattaggcttgtgtgaaactaattgcagttttcgctgttttttttaaatggcaaaacccacgattacttttgccccaacctaatagctgcacaaaactttctacttttaaaggggtcatgtgattgggtgaggctcgccccaataatctccttgttgagtaattcaaagtcaactgagaagtcctttctgccatgtggcctaataaaaccaaggagtgacagctcatcatgtcacatactcccaggggagaggcttagaaaaggccaagtgtcactggagaccattctaagaattctgcataccacacagctatgttccaatcacattgaactcttctccagatgggccttgggcactcttgcctctgaacctgactttttcccactgcatggaatggcctcctcacacatattcagaaatccaaatcttgcttattctcgtgagaccttgttcaaacgagaaatcctccatacaaacgcccttgattcttctgcctccctataacatctctcttctctaaacacctggagttgccaaaacatctttatggcacctcacatgctctcctgcagttacgagcatctcttagtgccccgttagactctaagtctcttgaaaaccagatgtcttatctgccttgcaaccctcagatatgacttgcacatagtgagtgctcaggaaattttctttgacaaataagtgtgtgaataaatatggattacataataccctaagttctattatctctgttgatgggacaaatttttaacaaaaaaatcatttaataacaatatctattgagaaaaatctaggtaacaggcactgaactacatctataaacagcgttttatttgccttgttattctctcatttgccagaagttattcaagatgcaacaagattccaatttccttctttccttttcctctgtagtttctcctaagcattgctactgagcagtatattccaaaggaagaaagaagcacaaaagctaagaagcaagaatcttgataacaggatgacctaaataaaaccatttcagggttacacagagtaagtctatgccctaaagcagtagctttacatctttaatgggcatgagaatcactagggaggcttataaaacatgcagattcagaatcagaaatgctgattccatagacttgaggcagggctaaggcctttacatctttcccaaggtgattctaatctaggtagcccaaggaactacacgtataaaaagcccatactaaaagatgctcctcatttggggaagttaatggggaaaagagtctttccattcattctccaaatccttattgagcctctgctattgaataccagagatataatggtaaaggagagactgaaaacacaccatgagctctcagtgctagccgtggccagaattcatggctttaccaatgggctgctattgtctttctaagcaaagagagttgtaatatgtttctccctgccggtagaatgtgtcacaatgttcttcaattttagcaatccacataatcgttctatcaattgtcatttactggtgtcctcacaattgcaatttttctccatgatttcttttacacaatcttcactgggatgtgtgcggagaagccaagaacaatgtttgcataaatacttccatcctctggctggatgaacttttttgaagactactgatatctcatacacacacacaacacacacacacacacacaaacacacacagaagcaaactgacactaacaacctgcatgttttcttgagatcttgaaactcactgggccctgctaggctaaatgtggtagtagtgatgggaaagagatggcaaggagagggagctaaaatacaataatttagataggagggagctatagcattctataattacaaatcacatcatgtaataattgcaccccacgcatcactatgcctcactagacctgatagcacaatgatacaccacagtcagaaccacagactcaagagagcaatcatagcttttgtaagatctcctttatcatatctgtactaggaatcctataactggaatctactttatttcacacaagacataacatatggggtgcatcccctcccttaatgagacaaattggaagatgaaactactgtagaccaaaaaatagaaggggccgggtgcggtgcctcatgcctgtaattccagcactctgggaggtcaagatgggaggactgtttgaggttaggagattgagaccagcctgggcagcatatcgagaacttgtgtctgcaaaagaaataaaaattagccaggcaaggtggtgtgcacttgtgtccccagctacttgggaggttgaggcaggaagaccccttaagcccaggaatttgaggctgtagtgggatatgattgtgcctgcactccagcctggtaacagagtgagaccatgtctctaaaaaaaagttaaaaattacaaggtctgggagatgcaataaatgcctataccctgagttctaattagctggtttcaggtagaatcaattgcatccagtgagaggaaaggaagcagacacctttctaagggtaggaggaggaactccctaaatttctcctctagaatacctccttcccgctgccagttgttccacatgatgtagtggtggtgaacacagccttcgggggcaggcggacctccacttacatccttcttccatcacacaccagctgggagatcttaagctggtcactaaccagagagaaactctggttctctgaaccagaacttccatctctgaagcagggagaagaatacctactttagaagtgctattaaacaaatacctactcagatgactaaatgagataatgaatgtaaaattgtcatcatagttattggtacagagtagctcttaataaatggcagctgaagtcgtcgataccaacagatcatagaggggtccatttgtgcactaggcccaaacccttgtggtgaagctgaaaaaacacagatgaaaggaacagaccttcccctcttggggattctagtctaagcgaagatgaataggcaagcaaacaatgccaaagcaagctgttaacactcttacgaattagtatacaggtctgcaggaatgaagtggaaaagggcagacccactttgagctacccagatatagaatcaatggaaagggtgtccttagcaaagaggacaaatgtttgaaggggcaggaacatcaggagcaggtgacagctgaatactagggcttgggggacactccggggataagaagaaagctttctgtgttggggtacgggcgaataaacatatccgtgggaggaagatgatgagtttgactttggacaaggtgatattgggtgtctgtgggtcagccacgtgtggtgctgtaggcaagtctggaggccgtgagacagatctgggctggagggagagatctggttgtatttctgtgcaaaatgcacctgaaaccaaatgtaaacagagtggtgaaaacaaaaagaaaaacagacccatcagagcgagaatgggacatttccttcaggaagacacaaggaagggtctccctaatgtcttctggaacatcggtatcatctttaattggatcttctctggggaataaaaggcttgttttactttaatatttatgtgttttgtcctatttacatttaaagtcaaaacttcaaaaatctttatttatctctctctttctcaatatatatcccttttaaagtttgtctaggatacactaattagttcagtttagcttttccacagtgtacaaatatatcaaaacgtcatgtgcactaaaaatatctacaatttttatttgttaacttaaacaaatttttaaaagctagcctgtatgtgtatataggtgtatgcataaacacacatatattttcattttaaagctattgtaaggccaggcgcagtggctcatgcctgtaatcccagcacattgggaagctgaagccggtggatcacctgaggtcaggggttcaagaccagcctggccaacatggtgaaacttcatctctactaaaaacacaaaagttagccaggagtggctgcacgtgtctgtaatgccagctattcgggaggctgagacaggagaattgcttgaacctgggaggcagaggttgcagtgagcccagatcgtgccactgtactccagcctgggtgacagtgtgagattctgtcttgaaataaataaataaataataaaataaacaaagctactataaccctaaaatggtaaccagaattattctcaaagcattttttttcaggtagaataagtagttcagcctagagcaatccaatttattactcaaggctcaactccaatacctctagctttacaaagaatttctctaagtgagaaattctcacttagagaatttctttttttttttttttttgagatggagtctcactctgtggcccaggctggagtgcagtggtgtgatctgggttcactgcaagctccgcctcctgggttcacgccattctcctgcctcagccttcagagtagctgggactacaggcacctaattttttttttgtatttttagtagagacggggtttcatcatgttagccaggatggtctccatctcctgacctcgtgatccacccacctcggcctcccaaagtgctgggattacaggtgtgagccaccgtgcccggctagagaatttcttgactggcccaagttcacccttctctccgcctatgtagcacttatagccatttgttccagggttggcttaattctctattatgagctacttgagaagacacatagtttcctacacatccttgtagcatccctggtacctaatgaactgctggccacagagctggcatacacgtggcattggttgtactagcctagactgctaattggcaggaagaccccttacacctaggaatttgaggctgtagggtcttctgaggctgaggttgaggcatctagggttttgtttttgagcatctctgggaagccttggactcatcaaactctaaggcagaccaaaatcactgaagaacaagggagagagaaaaggcatggaagtcccgatttgtgagagaaagtctgctccattctgagttctgtgtctgcagtatacaggcaggcctggtgtttggcgtctgtataatccacaccagccacctacaaaggcctggaaaaaagcaagtgcccctctaagggcttgtcgtgttttcccagacaccctcattacatgctgctgctttcagtgacgccactggctgacctcggagatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccctgagtgccaagaggatagagcaactacaggcagtatttgtgcattctaagctcaactcagcagcaattcccaaagctgccttttatgggaaattgctatgtttcaacaggaatttgaagaaaggcccacaaaatattaaaaggcatcttctgtatctggaaatggagtgtatcaagggcagctgtcacctgcactgcagtggcctccttgtgtaccagctccctggaagatgagtcagattctaaggtagcacagaaaattcacaggtgtgagtcaagcctgctccaggactggttaaaaccaaccaaagggaatgatttggtggctccaaaagtgaatcgcagattgtgtaacatcaaaaggttgaaaaccccaaaatgcaacaacataaggcagaaaggctccaactctctacctcctatggatgattagaaaaaaaacatgaattgcattttggctttacatgtgtaagaggaaaaaaaatcaggatttgaaagatggataagagaaagtaatgatataagaaaatattataggcaacaacaacaacaaaagcatattcaaagtcccaaatgcatgaaggaacccagtatatacattcatggagttgcaaatcacttgcatggtgggctacagggtgtataagagggaagaaaggaggttaaaaccaaggacagttaactagatgctaacactttccttaagcatgacagaagcccatagaatcccagccgactccatctccatatacacactaagatctaagtttcttgagtacagaaaatattttttctcttgtttatgatggactccaagcatcaaggatagggcctggtacacagtaggcacttaataactatttgttgaataaaaaaatgaatagacgaaccatgaagtcagggctccggtggatcaactgaaggatcaatacaagaggtgatcaataagcaatggatattgttattataattggtattcatgtcagggggttaaatatgaaagctcagtgaaaactgttagttaattgtgctgggtatcccgatctgaaggatttaaggttttgttgttttgttttgagacaaaaccttgctctgtcacccaggttgaagtgcagtggtgcgatctcagctcactgcaaccctcgcctcccaggttcaagtgattctcctgcctcagcctcctgagtagctgggattacaggcaccaccaccatgccgggctaattttttgtatttcagtagagacgagatttcatcatgttgcccaggttggtcttgaactcctgagctcaggcaatctgactgccttggcctcccaaagtgctaggattacaggcatgagccaccaagcccggcccggatttaggtttttttttaaactaagcacaatgacatacaacaaaatgaatggatcttgtgtcataatttgatgccttttgacaaatgttcaagataggaaataactgccatcactccagaaaattccctgtgcccctgtcctgtcaactgcactcacccacagaagcaaccactattctgatatctaaccccatagggaacgtttgcctcccttgaactttatgtaaatggaatcacacaatataatctttcatgtcttcacgtaatataatctttcgtgtctttctttgattccatataatgtttttcaattcatccatgttgttgtacatattactaggccattctgttttattaatataccataatttgttcattcatttccttgttgatggacattgaattatttctgatgttttgctataatgaataaagttgcaatgaacattcttgtacaagtattactttttggatatatgtttatctttctttgggataaataactaggagtaaaattgctggataagatttgtgtgtgtatgtgtacgtttattaaaaaacaaacaaaaaaaacacacacacagtttttggccaggcgcgtggctcacgcctgtgatctcagcactttgggaggctgaggcgggtggatcacttgaggtcaagagtctgagaccagcctggccaacatggtgcaactatctctaccaaaaatataaaaaattagcctctgtggtggcacatgcctgtaatcccagctactcaggggggctgaggtggagtctcgttctctcgcccaggctggagtgcagtagctcaatcttggctcaccggaacctccacctcccggattcaagtgattcttgtgcctcagcctcccaagcagctgggactacaggtgcacaccaccatgcccagctaatttttgtatttttagtagagacggggtttcaccatattggtcaggctggtctcgaactcctgacctcaggtggtccacctgccttggcctcccaaagtgttggaattacaagtgttagaaaataaaaaagagggctgggcacagtggctaacagtgtctttagatgagcaaaagtttttaattttgatgaagtacagtttatttactgcttaatggtttttcatatttggtttaagaaatctgaggctcacagatcacaaaaatattctcctacattttcttctagatagttttatctttcacatttaagcctgtaatctatttcaggtaattatgtgtgcatgcataatgtgagcaatgggtcaaggttttttttttccatgtagattgcctgtttatccaataccatttattaaaaagattttccttttccctgttgtcataatcattgatcaaaaatcatttgaatgtgcctatgtggatctattttcattatttcatcattaaataagatataagcttatttaatatatatattttatgcaccgtagtctaacttagaataagacagaaaaacttaaaaattgtcaaataaagcatctcatgatatgcgtatgtgcatataatatatataaatcgatatatatattataggtttttcatagataccctttatcagattgaggaatttaccatctttatcataactggatattgaattttgtcaaatgctttttccgcatctattgaaatgaccatatttccccctttactctgttaatgtggtaaattaatttaatttttaaatgttaaactaatcttgcattcctcagatagcccccacttatccatgatgtattatcctttttaaaatatattattacattatgattagtaacatattgaaaaactttgtatagagtgctgttatttcttttaaatgtttgttatagatagacgaagccatctaggccaggagtttctcttttgtctttttaaaatgggaaagtttttaggtatattttcagtttttcagcaaatatgagctattcagatcgtcaatacctacatctcagttgtagaaaattgtgtttcttcagaatttgcccattttatctatatcgttgaatttgttgtcataaatttttcataatattctttttatcttttaatgcctgtaggatctgtagtgtctgtaagtgatagtccctcttgcatttttaatattggcttatttgtgttttctttcttttgtgtgatcattattgctagcgactgtgaattttattagtcatttcaaagaactagcttttggctttgttgatttttttctatggcttgtgttccaccttgttgatttttacttgtgtatttatgatttttttcttctacttcatttgttcactttgctcttttctaacttctaaatttataagcttaaatcattgacactgaattcacactttccttttttattataagcagttaaagctatgaatttcttagtgtgccttcaatcttattcctcaaattttgatattttgtgttttcattatcattctgactaaagtattttctaatgtctttctgatttcttctttgacctataggtttagaagtgtgttgccatttccaaatatttggagattttctagatatatttttgttactaatttttattttaatgctgttatgatcaaagaatgcaccctccattatttcaattcttctaaacacattgagacttttgttttatgctccagaatgtagtctactttggtggatttcccatgtgcactcgaaaggctgtgcattttatagttgctgggtgtaggatgcaaaactttcctaagcttcctcctcactgttcttttctaggaatctgtcattgtctccccagagtcaatgcttctgtttgtatagtatttccccctgatttcagtcaattacattatgtctcccacagcacatcctatatcttccttccctctagggtcactcaggcctccatttgatgtactaagtgaagataaatttcaagatgctaaagtagttcagaggtcatgcattgcttgtcaaaaaacataacaaaaaaataagataacaacgtaacaacaaaggctttctgatcccttttattctactctttatacgaaattgtagcgactaacttaagcatttaattatggaggaggagggagggcaactgaaccagatattgtcattgtatgtatgagatcatctgtaaattccctgtgacatctctcctctctgacccaggtcatgacatgtatggtacataagatgatgatttttttctttgcaaacgattttttgtattttcaatagctaatatacatgtagttgaaaatatgctttataagaaaaataacctccctctctaactcatgatttacagaagtgatacatttaagtttttaaaattagtttatttaaagcaaaagactgagtacatgaaaatacagagggttcgttcatatggcaatgactatggtacacaattaggaagtttaggcaaacttctatgatcattgctacatagtcaacacttattagtgtaatgctgcaacccagacttcactgtctttaaattatccttagttcagacctttcctactgggatttgagaacagacatacagcgcaccacacaattaccacagttcacccagagaaagcattccaattgcaccttacagatttagtctgccttgttgcaagaaagacgtgctcttggctgtgagatgggatctagagcagctcaacaggaaatgcgtgggagaaagaagcactgtgagcccctttattgcccatgctttcttccctcccctgcattcagcacacagaaggatgctcaccttttcccattcccggtctttgttcagcacaatcaccaccagcctggggtgcacctggtagccttcctcagtgaaggataagtctttgccatcccatgtaacattgaccataaatctagaaaggggaagagagaaagacaaatttttaggaaagaattagagcaatcgaacaaataagtggatgccaccattaatggaatactgaaaaattataaacttacaatgctatattcatcacaagaagcctctctgcagaagtattaataaccatgcaaccattgctagttgaccatgctttagtaattgactgtaattaacacgtggaatgtaagctttttgtcctgccagattcatagacctatattcaaatgatcttcttacaggaagatctgaaaacacattctattatactctaacaaacttccctgaaggaagctgcttgctcataaaccacatggcattcaatgttgaaaaaatgacattccattattcattatttattcaactaatatatatgaagcatttgctatatgtcaggactcagctagttggttcagggtaaataagaaaatgaacataattcccaccctcaagaagtttagagtctaagggggaggatagtcatgaattgattaaacacagatttatgacaaatgatacaagggacgggagagtatgctataagaaagtgaaataggggtgaggcaaggctgaggaagtgcagcttgacctgaaggctcaattggcattaactaggcaagaaaagacacaaacaggcaaaagaggcaacatgtgcaaagactctgtggtgtgcataccaggaactgaatgcagaccagagaggctgaagcagagaaagacaggaaaatgtgagatcaggtgaggctgagaagatgaataggaacagaaagtgcaggattttagagaccatgttaaatgtctgtcttaaaaccgtgggaaggtgcaggcatggtggctcacacctgtaatcccagcactttgggaggctgaggtaggggaatcacctgaagtcaggagttcgagaccagcctgaccaacatggagaaaccccgtctctactaaaaatacaaaaaaattagctgggcatggtggtgcaaacctgtattcccagctactcagaaggctgaggcaggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattggaggggaaccagagcgggtacagagggactacttatgctattcttacaaaccaggtcaaagataatggtggctttgactctggttgtggccaaagaagaagagaaggaggaagagaaaaagcaacagcaaacaagaccgagtggagagatatttaggaggtatttagtgaaagattagatgaggggaagggagaaagaggcatcaacgatgactcctagaatctaccttatataacatgtataaacttaatttttggtctaggtgttttcattgcaggtaacatctatctgccttacaacatttataccctcatcactcctcaaagccaccttggcctgtactcaggctgaactcagagagccaaggcagacttcatctcccagatttcgggtgagaggttccccaagggatccgctctccttgcagcttgagaaaaatgtgatgtcgttaaagacatctgagacaacatggtggtggccactcagcagacacaagatacatccaatatggtggattgaagcattcaaagacttccccagaaagatactgtgtcacttgcttcatattccattaacatccagagatgctaaaaagtgaaaaaaaaaaaaaaaaagaagaagaagaagaagagaactaggctacaagaaattttaagaagagacactggcctaatgggtcacatgtacatccctggaccagcatggtgcagaagcgactgatgggggtgttgtgtgggggagaatctggtttccaaggacaaagtgaagaaattggggaaaaggaaaagagcaaatattgtgtatttattcaacagaccattcgggtcattgaaaatcatgtttttgaagacaaattaatgatgcagagaaaatgcttactatttaatgttaaagaagcagaaaagaggataaaaacagggcttgtctatgtctaaaagggttatgggtatttttcatttttttgtgtgtgtatctttgtattcttcaagttctctgcaatcaaatactttaacaaacagaaaactaaaacactgctattctagaaggaacaaaggataatcactattctatctggtttatttggggtatctcttatcacttcctagaaaggttttttgttttttgtttttatttttgttattttttttaagacggagtctcactctgtagcccaggctgtagtgcattggcacaatcttggctcactgcaacctccgcctcccaggttcaaatgattctcctgcctcagccttccaagtagctagggttacaggtgcccaccactatgcccagctaatttttgtatttttagtagatacagggttttgccatgttgaccaggctggtcccgaactcctgacctcaggtgatccgcctgcctctggctcccaaagtgctgggattacaggcatgagccaccacacctgccggaaggatattttcttgatttaacaactaattactctatttattatagagacgacggtcaaagaaagcatatttactgtatgcctggtatataggtcagggcttatagtaagtcttatagatacagaaataaaaaacacagtgtttgtcttctttcttacccacattcttataattcaatggcatagacacataaacaatgacagtacctataatgccacttattcactgatggagagtaaatgtaagaaggtgagacaacacagacaaaagggtccctaactcaacctggggaatctggggagggcttcccagggaatcttaatgggtgaaggggttgaggcaggagaaagcattctgggcagaggcatcatcttaagtaaagagtcagcaaaggtagtaacacacgctagaggaagtaggaaacggcttagtaaggcagatggttatgttatgtgcagtgggatgagtctgcagaggatccctgaagccagatcataatggacacactgaagggtttggatttgttcagaaggtcatggtgagccaggaaagattttaagtagaggagtgatatactcagatttgcagccaataggggcagaagtgaaaatgcttctctgcacttgaggggacttgaacatttttgttcacggcttaaaaaccattcattatctagacaattgaaacttttttttctctcttccttctcccctttgatgtttcctggctggagtttgatgaactaaatgaacatggtccagatacacacagctaggtgtgctccacctcacacctcttattgagactctaaagaagatatttgcatggactgtttagtggagaactggagtcaaattcctcattattagcaggacttcaaagtaactaattgagcctaagttaagctgtttttattttttaagctgacattttggttccatttcccagggttatttttagccccgtcacattgtctggcatactgtgggggctcagttaatgtttggcaagtatgttgacagatcatcaccaaagggaaatccacccatccatacattcatccatctatatatctacccttccaaacatctgtcaatgcagtcattcatctatccatcaatccatcaatacatttacctgtccattcatccatctatcaatacattcatcaatccattaatccatccatccatccatctatccgtcaatacattcattaatacgttcatccattcttccatccattaggcatgtttgagcatctcctatgtatcacaccctgtaccagaactatgccatgaaaatgatacaaaaatgaccaaaaatacttaatttttcaaggttggggagagggacacacaaaataactataacgaagaacaataagtgtaaaaatagagatatggactaagttgttggaaagcataagagaagcagtggctaattctatggtgattccatgactggaaaaaggaaacaaagttaaagggatttgggttgtgctgagaaggaagaggaaggaaaagttgagcagctcttgctcatgcacatggagaaaatgcaaagtccaaggcagaaaaccctgaaacatcatgatgtgttcaatgagctgccgtcagttcacaataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcagtacaaaaactaccgacaaagaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaaccttcacctcccaggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaatttcccatctccatgttctccacttgttcccttttcttccatttggtagtaaaatcagatggaattagcagagtgattactgagacgcaaacactgttcttcagattatatgaaaataactatgcagaaatcctcatgcttcagatttttctgtgttcctctaagattcaatattctgggtgaatgactccatatactcaatgttaatattgtctttttctattaaaagtcttcagtcccttgggaggggggaaaaaaaaacctctaacagaaatttctgctgaacagtaatttcattatgaagttggcagggagcaagtacctattaccttcaattcccccacccaatttctaggaaggacaatccatatttccatgggctttcttcccatttaaacttgctccagagcagagttctttacctagggaaataccattttacaccacattgatcagttcccattaacacctgctgggcacttgtattaaacagtaaaatcttgtcattgttttgcttatctctacaaaattgatcataaagctttagtggtcagataaaatgtcagaaattctgactgcttctaagcctcaaattacagcttcaatatctccatcaggagcaataagtacacagaagcatgctggcaaatagagaaggggaagactctagtgatttgccaagacgacttctgtgttgtcatccactggtggtaaagtgctaagttgttttttattgccagtgacagtcacaacactaaatacatatatatttacatattttatatatataaaaaaatacataaaatacgtacatatatatacacatttcctctggtatttacagtattaagtgtatgaagctgaagtccaggttaaataaacattcctcttccccttgtgttttgtgctctatgaatggtgatgcatggtgatcagagataacattgaaaaataggtagacaatatttcctatatttcctatattatgattgaatataaacggggccagaattgtccaattctcactaggcctgctatcacgttagatagccagccaccaaccacgtgtagctattgagcatttgaaatgtggttagtctgaattgaaatgtgccatccatgtaaaaatacacacagaattttgaagacttcgtatttttcaaaagagtaaaaggtctcataaataattttaggttgatttcatgttggagtagtttaggcatgttgggttaaataaaatatattattaaaattaattttatctgcttctcttcacttttttaatgggctaccagaaaatttaagttacatgtgacttgcattatatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtgctgaacatgtgcagaatgaataaaagaataacttgctgcttctatgttgttgaggtttcatgacatcgaggaaagagaataggctttacagtgagacagtacctggcaccttgggcagcgtatttaaaatctactgagcctccatttcctttttttttttttttttttttgcaaaaatggattaagttaaaccatacagactagccatgacagtttcatatggtttaacctaacttcatagttcgcataaaatgcctagcacagtgcctggtatacagctattaataaatagtagttaacattgatgcaaattttccatgcagttttcactctttttccaccctgtcatattttctaacaccctactacaaatgcaatgctttttaaagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattcactatttcccccttagactttaattctcttactgtttcacaaatgccaccataacccatttagtgtttctcaattttcggttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgttttttttttttctcttacaagcattctcctggtgtttgcaaatcccttcaactttgatgtctatcttagtgctttctcatcttccattaactattccctcatgggcgcaaatgaatcctcatccctctttagtacaacttcactctacttttgccagttttcaattcccaactcatccacctcctccttctcttcttcctctgaatatccttgcgctgtcttttgacggcagcaccttcctctttgccctggtgctcaatttcatatacagtactcattggtggtttcctgttccccgtgaacaattaaaaagtcttaacagcagagccagaacttaaacatcaaggcagagaaggccaggcgcggtggctcgcacctgtaatcccagcactttgggatgccaaggcaggtggatcacctgaagtcaggagtttgagaccagcctggccaacatggtgaaactccatctctactaaaaataccaaaaattagccaagcgtagtggcaggcatctataatcccagctactcatgtggctgagacaggagaaccacttgaatccaggaggtggaggttgtggtgagtggagatcgcaccattgcactctagcctgggcaacaagagcaaaactccgtctcaaaaaaaaaaaaaaaaaaaaaaaaaagtcaagacagaaaaataataactccaacacagagatactctaaaatgggctcagaaaccacaacataaagaaacagaaagaagaaaaggatttttataaggagaaaagtattgtttattctttcaacacaaattctattgtggtcaattaaaaaaataatgttagttgtcttggctgagcaatactgaattttaaagattttaggacacaaaatagaaatcttcttaagggcaggggtctttgttctgatcactgcaactctaaaacacctagaagagggtgtgtcctgacttttaagccagagcttaaaagtaactgtggaataaatgaaaaaatgaatgagcaggcataggtctctaggatcctgcacactaaatatttgattccagtacaacaactgccaagaggcaatattgcaagaattggatagcctgagttagaattcaattttgtggctttcaacctcaggtaagtatcctcagttctcagagtatttgtttccttttctgtaaaagtgaggtcataacagccatgtcactgggtaattatagggatcacactaaatgacgtctaatgagatacacaacgtgataaaggccagcagagtgcttggcacattatgggtgtctgctaaactatggtaggggtagcagtagttgtcatggttttatataattgtctttcttcctcctaaaatttggggtcaaaagctttcttttaaatgctggagaatcattttggctactaattccagtccccgaagggaggcaatgagagctcgtctaggccctaccccaaggagagaggaggagctcatttgattgttcagagctcacagcaccccctggactgggcttactggtagatgaagcttctatggtgcaaagcctgtaatccatgtgccaccctgggcatccaactctattcagggagcacacctgagtcaagggtgactccttaaggagaggaccctatatgctgtcttttgtaatacaaccgctatgtctaaaacttgaggtaggttaggacaaagcttttttctgtaaatatgactctcctcctcccaactccacagagcatacctgaaactttgacccaactggccaaagatttcaactagaagcagggtgtatagagtagggtctaagatgcatgtcctaattctactttattgggagttattggaattctgaatgaccattaataaagtggttcttcgaatctcaggctgctcttggaacctggggtgaggaatctggaaatgctgggtagtatttataacactgttaaaatagcaccaaatgcgtcaccattaacctctcatgactaaggatcacctaaccactttgaaccagctggcacaagagccagtggaaccagctcacataatgagcttctaatccaaatgagcagaaaaaaatgtatgtaacgtggcgtgcatttccaagttcactcaatcacctgtgcctatgctgccaaattattcaagatctccaagtggcagatgtgcgtgcatgttgctcttccaaccaaaaactatagaatgagatgatatggatcaattgacattcaattcaaggtgcgatttttatttcagaatttctggatattcacatactggaatatagaattcataaaagcagggattttgcctggtttttccttctgctgctttttctcccttgaagaacctagaatactacctggtataaagtagatgctcaatgcaaatttgtggaatgaacaaaagtctcaactctctgtctttttgttttctttcgtttttccttttgatgatgagccctactttgtctctctgtccagtgggtgtctacctgctttctgtgaattacaactagacatccagtgaggtaactcaaaggcagagaggaaaggtcgggggtgatatgccaatgggactctaacattcctaactccacttacatcgttaatatgttgttcttttttatacgatattatttggggaaaatacatattatatatatatttttgagacacagtcttgtctgtcaccccagctggagtgcaatggtgcgacctcggctcactgcaaactccacatcccgggttcaagtgattctcgtgcctcagcctcccgagtagctgagattacaggtgtgcaacaccacacctggctaattgtttgtatttttagtagagaaggggttggtcaggctggtctcaaactcctgacctcaaatgctccatctgcctcggcctcccaaagtgctgggattacaggcatgagccaccacatcccacgcctgaccagggaaaatatctttatattaatcaattaaacaaataaactagaagacaattaagatatttgctcatccatgctgctacaaaagaactctggtcttcaaatcaggagacctagaatcttgtcctgtctccctgaatatgtgagtaagagcgatcacttaaggataagggactaaaatgtatttagcctctaatatatgttgaatggtgtgccagatactttccatatgttacctgaattctcacccaaagaactaagtgcagattttctcattttacagagagaaaacagaggtgggttttataatggtgtgaaaagctatacgggtcaagagacttctggttgttcatcaatatcctcttttcttctgccttagtaacagaaattctatttttagaggggcacagaacctccaataataaagcttacatttctagcttccctagtagctaggcatgaccctatgacaattttctggataataggaagacagaaggtatgatatgcataacttataggaagtactgtaaaagaaggaggtgagcccgtctttgttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctgagttaagcagtcaactggttatttgaaccaaaatctttcagatttcaaaggctttgaattaaggtgcaccagcactcatttaacctccctacacctcagttgccctctctgaaaaatgggggggtggtaccacacacttctttatttttccaactctacaatatttaattttctctcctcatcttcccctactcccatgaatacacaatgcatttggtcctaaccccatctcttagtatatgctgttcctcccacccagaatgcctttctgcctcatcctcttcagtctaaacccagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatccgccacctcggcctcccaaagtgctgggattacaggcgtgagtcaccgtgcccggcctctcttggttttcttaatccattcctcatgtgacagcacttagcaatacattgcctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttgacaccaaacacaaggaaggctgagcaaggacaataagccaggccacaaatctttgtccatattatttttctgcagctgtaattcctgttcattccctgcatcaggcttattggccacccctcatgatcatctcaaataatacctcttccacaaagtattacttgactccttcaggttagacgcatcctcttccaactctcaacccctgttcttcatgtggcacacaccacttagagggcaccttctttatttatgttggtcccaaccactcaggactaattttaaaaagacacctctttctgaagaccctttactaccatttgccaaaacaactgtcaaaataaaacacaaatgtttgatgaagctgatatgaagggtgctcctggacttgtgtaattcatagcctgaacaatgttatcacctctcccagactgtcaactccctgaggataagaattcataactcagtaccctgaactctgggagcactgtgagttgcagagagagtggatttagagacaggcaaactgaagttcagttttaaatccacaactgttggtgtttatacccttaaggaaatcaagttattccagactcagctcacttctgtgtcaatgggggtaaggccgctgttttcaccagttcaggctgctataccaaactatcacagtgtgggtggcttaactaacaaacatttgcatctcacagttctggaagctggaaagttcaagatcaaggcaccagcagatttggtgtctggtgaaagccctcttgcctgtttacagaaggctgtcttcctaaagtgtactcacatggtggagagagatctacttcatgtctcctcctctttttctttttctttttcttttcttttcttttgagacagagtcttgctctgtcacccagcctggagtgcagcagcgtgatctcagcttactgcaacctccacctcccgggttcaagcaattctcatgtctctgtctccccagtagctgggattacaggtgtgcaccaccaagcccagctaattttttgcattattaatgaagacagggtttttctatgtgggccaggctgctctcagtctcctggcctcaagtgatctgtccacctcagcctcccaaagtgctgggattacaagggtgagccaccgtgcctggctcttcctctttttataagggcattagttccattgcaagggccccaccctcatgacatcatctaaccctaattacctcccaaagccccacctccagataccatccctctggggattagggtttcaacataaactttcagtccataacaaccacacagcactgttgcgaagtttcatggtggcatcatgagagttagaaggggtcctatgataagcacattgtttttgattgacatccagtagtagtgtgaccaaccatcccagttgtcccagcactgaggtgtttcctttggcatgaaaatttcaatgctaaaaccaaaaccataaattatggaccacaaattaagagtttgatccactaagaaatataccaaaaggacagctatagaaaggcttcaaatctacttcttagtaaacacatcacttcaataaacatccattgaacatctactttatgctagcaaagtataggaattaaagaggtaagtaaaaattgtgtggtcctttctctgcaatcatttagagtttaagggaaaggcagatcctatgcaaataattacaataaatggcaatatgtctgcagctaatgttcctgttgctgtaagaacattaggagggggacctgacccatcagaatactggttaatcttccattactccatttctacttgcttttttcagggcaaacaccaagttgatttatcagaaagaatacaaatttctcatgcttttcagaactgggcagataatatcaatgagtaaaacgagccaggtgcaagatgataacagtggtgaaaatcttagctaaaggcattcaaattcatttaaatgtaaatgaaataaaaccgatctactggctgctcatttggactgtctgttctaaacgaactgaaaaatattcatgttccttcctctcgcaaaaacctaggcttccttctataccagtacagttcacgggactgcatcccttctggggcagagcgatgtgcctatggatatacaataagcccggatcttcgaaaaagtcctcccttatgtatatcagaacacttatttgtttccctggccataaaaatatatacaagggggaggggtgcacctgtcccatggcggatcaattagattctgtctcctaggaatttgaaagttgataggtaagacacacagaccaggaattgttggctctaaaccaatgtaatagtgactctccttcgtcgaggaatgttgcctcaccttatgacctttccaagattagttgctcaacttatactttgatttttaaaaggtctagtaaagccccaaacaatattttctattgtttctccttcattaccttttaattaaattaagctaatcaggctttatttctgttgcttgctaccaaaatgtctttcactttgttcctacctgcactataacatctgtactgctattcagattcctacatttcatcctccatactcatatcaagcccacttgccagatgaaatgttcccacacctcagttctgatcatgtgccacccttctcaaaaccctgaaatggatccccactgtccaaaaataaaatccatgctccttggcaactttaatttttccaaccttccatcctaaaactgttcttaacagtatcctgcattggagcaaacccaaaccactcatggtatcccagtaaagtcttgtgattttccacttcttagcttttgttcctacacctccctccactggaaatgcagtcatagctgttgtttctggttactttcatttcctgataatagatcttcccccacgaaccctggagggcatctctggccacagagattggttcagggatcggtacgtgactcaatctcattcaaacacatttcttctctgggaattttttattgcaactagaagggatcactgtctttctggattaaaaaagtatgtgaatcaatacttagtttagatgagttcattccctatctcctggaggcaaacaactcaccttaacagggagaaatatggaaaggagaggaagacctgaagacaccgtttgagcctggatctagacacgcaagataacaagtccatcctttctagttgaatggaccaataaatcattttgcacttttttgtgcctaagttaacaagaatttactttctctcagtgaaaatcacaaatttttgtttttgttttgttttgttttcaagatagggtcttgctgtgttgcccaggctggagtgcagtggcacaatcacagctcactgcggcctcaacctccggggctcaagtgatcctcctacctcagcctccttagtagctaggtaatttctgtatttcttgtagacagggtttcaccacattgctcaggctggtcatgaacccttggactcgagcaatctgcccaccttggcctcccaaagtgctgggattacaggcatgaatcacgatgcctgaccacaaaagtcttgtttttctattcagccatcgaaggacatttaggtgttttacagtttggggcaattatgaaaagagattataaacatttgtgcacaggtttttgtgtgaccataggttaaatacctaagagtgagatcgttgtatggataaacaatgaaatacaatatgggaatacaaacaatgaattatagaaacacagaacagcttgaatgaattgcagaggcattctactgattgacggaagtgaccctcagaaggttacacactgtatgattctatcttatatgacattctccgaaacccaaaactacagacacagagaagagatcagtgattgtgtgactagagcagaaagtgtggctgtaagtagacatgtaagggattttgggggctggtgtgatggaacggctctgaatcctgattgcagtcatgattatacgaatctgtgtgccaagaatcatacagtcatgcctccaacagtcaattttactagatattatttttaaaaataaaatttaaaattttcattaaaaaataaaagaaaataaagcaaaatcacaagtctcatttaaatacaaagatctgtctcgcctaaatattcacatgttcaaatcctccaaaactgagcagagagtccaccttttcccaaaaggctcactgagcttccagcctccactccctcctcaaaactcccctcacttcctctgcagctccatttccaccttagagtttttcaaacacatacattctcttctttgctggagggtaagctcccgggaaacagggatcatgtctgagccctcgctgcgtgccctcacccctgcacagtgtctggcatgtggtaggcggtcagtgaccatttgctgaatgagcaggagcagattttcatctggccggagctggagtcctgagcagcgttgagaatgtcccggtgtgctggatggcatgtgagaaccatcaggacagagttcactgtattctggcctaaatagaggtctgaactctgccgggcctcataatgaaacttgacagcactatgtacattagcagtaataatgtttcacacccggacatggatttctggtgtggaaatgtgtcccctaaaagactaagctctgcaagtcccagtcactgctctgatattcatatcttcatccataattgcaaggtcaccctcttggtgggagaagagaatgatgtgtttaccacctaaagggcaaaggaactgctgggtggaggaggagttttgttttgttttgttttgtttttctgtataaatggtaaaaagaatatagcttttttttctttttactatagtccttcttccagttttttttcccaaatagctataaagggttaatcttacaactacagagaaataattgtggggagagtaggaggaagagaaagagggaacaaaggaggagaaagaggaaaagaagagaagtcaaagagaagaaaacccaggggaagaaggagaagaagaagacagaccaacaggagagtaaagggagaagtgtgggaaaaggaaaagggctgttttcttacacttgataatgaaacaaaatggagtttgaagcccagcagagcccttcaggaaagctggccagggctgtgtgggaggagatcctcacgtcagtacgatgagagcaagagagagtggcaagatggattgcgtccagagctgggcgagcagcaaacaggaagggagcagtgaggggatgcaccacaccgtggcctggcaccaggccctccctggtgacattgggaaagtaggtcagtttcagagctggctgggggatgaatggtcagccaggagcaagtggtgggaattaaagatgctgagtgagaggttgacttaagcatgggatctaggagacagggagtgttattagtctgtttttcacactgctgataaagacatacctgaactgggaagaaaaagaggtttaatggacttataattccatgtggctggggaggcctcacaatcatggtggaaggcaaggaggaccaagtcatgtcttacatggaagggagcaggcaaaaagagtttgtgcagggaaactccacctttttaaaaccatcagatctcatgagacttattcactatcacaagaaaagcatgggaaaaacccgcccctatgattcaattacctcccaccaggtccttcccacaacatgtggtaattcaagatgagatatgggtggggacaatgccaaaccatatcagggagcttccctagcacaacagaaagaatgaaagccagccctaggttgagctgtccagtagatctttctagcacaatggcaatatatctgtcacatccagtatggcagccactagtcacctgttgccattgagcaactgaaatgtggatagtgtgactgaggatatgaattttccattttattttacttaatttccatttaaatagccacatatggctagtggctggctgtcatatcagatagcttaagtacagagaaaagagctgtgtggatcacattcaaggagaaattgattgccaagaggatcccaaaaggctgttttctgaaatgccttaagtgtatttgagatggtacacagatgcatttagatggcacatgggcaaactttatttttagaattagattttattattttcatgtatattggaaaaatggaactagcatctcaaacccactgtttcatatatatcgttgcttaagaagacgctatggtggaattttatgtctctaaaagattaggtcaatgtaggtaaaaagtactatgttaacaataccacagagggcttacagatctagcaaaaagtaatacatgtatttcatgtaaacggaatcatacactatgtggccttttgtgcctggcctctttcacgtagcctaatgttttcaaggttcatcaatgttggaaaacatatttcattcctttatggctcatattctatagtatggacaaaaccacattaagttcatccatcaaatgtctgttgatggacatctaggtttacactttgggttactatgaacagtgcttctaggaacattctagtacaagtttttcagtttttgtttgaatacctatttttaatttggggaggtatctaactagaagtagaatcttttaggggtagggtaatgaggtggttctgaaactagatagtggtgatggttgtacaacattgtgaatgcacttaatgccactgaattatacagtttaaattgttaaaatggcaaattttttgttttctgtatttttccacaacaaagaatcattttaaatgaaagtaacaaagaaagcaagcagatggctgaatagaactgagctaattcaaggatacaataagtagttgaaaagcagtcatagctgagatatgagatttaaactcatatttgagtctcatatgaagtctcagagttcttttttttttttttttttttgagacggagtcttgccgttgcccaggctggagtgcagtggtgcgatctcggctcactgcaacctctgcctcccaggtttaagtgattctcctgcctcagcctcctgagtagctgggactacaggtgcccaccactacacctggctaatttttgtatttttagtagaaatggagtttcaccatgttggccagtctggcctcaaactcctgacctcagaccatctgcctgccttggcctcccaaagtgctgggattacaggcatgagccactgcacccagccttagagttcttttgattcaatcttctgcccctgaatcatttctacaatacctctggcagataggtgggcctatttttctgcttgcctgcttccatggagtaaagacctcagtacctctccaaaacaaccagtatcattggtgtatagatacacattttagaaaggtcttctttactttaactaaaaaaaaaaaatccatcttgtaattttcacattttatcctatagtccccagaattatccaaaataatgtattcctactatgtgcctggctaacagcacaggagctaacagcagccttaaataggagtgacagcaaagagttagcggaggtcagcccgtgtagagaagtttccaaaatgaccataagctgagtgtggtggctcacacttgtaatcacagcattctgggaggccaaggtgggagaatcacttgaggccaggagtttgagaccagcttgggtaacatagagagatgctcgtctctaaaataaacaaacaaaatggtcataaaatgaatgaaaggaacagtgaaacacagtgattacatgcactagctctggagccagaaaaccttaaatttatatgctaactcagctagttcctagtgttagcgatcttgggcaagttatttaactatccgtagcctgtttcttgatcagtaaaatgggcataatcatagcagccatgccataggtttgtcatgagtataaaatgagaattcatcgagagtcctgagcaccatcccaatccctgtatccagtggctctcattaatattagcccatgaatgttaacaatgccctccaacttaggaacaaggaagtgcatttggaaaaacatagctctacaaaggtctgtctcctaacctgtgatggccatttacccatcatgtaacagggagaagcacatgattataatgtctagaaaattttaaataattctacagaaaaaaacctgagtataaaggttgagtgaacacttttacacttttgggaagtttctatgacttatttaagtgatgattcccacccttagtcaagctgaaaagcagctcctaaagggtgagaggcattaaggtattgtgcttaagagcatgactgggcaagctattcactctgcatcttagttttctcaactgtaagatggggttaatatccctacctcatagtgttggtgggaggattaaatgagttagtacctgtaatgtgctggcacacagtgagcacaaaatatgtgttaactatgatgaggatgatggtgatggtggtgatggtgatgatggtggtgatggtaatgacgatgacgataaaggaaaaggagaaggaagaagaagaatggggaaaaaaaggaagaagatgttggtaattatggcaatgatgatgatggcaatgatgatagataatgatgttggtgatggtgtgatgttgatagcaatggtggtagtgattatggagatgatgctataaatggtgatggcaatgatgtgatgttgatgatgatgacgatgataccaatgtcggcatcatttagtctctgccctttccagaaccatggttccagaaacaccattttcagaacgtagcccctgatgaaatgcatataaaagctttatgaagctgcaaaaggaataatgaaaagataaagcactcttcttaaaattcagagtaagtgggtggggtggggggagggtagtacaaagaagtggttaagaacagaagctttggacttaagagtccttgctttgtatctcagtattgctagttatgagtctgcctctttaattgtgccaactgggattcatgtttaaaatctgcataatggggataataaaaatactcatatggagtatctctgcgtattaaaagggcaatatgcacaaaacactttgtagagagcctggaacatagtaactgaagaataaacattagttatcactggtattaatgggcacaattaaaggtgaatgatctgagccaaggaacaaatgctattgaatttcatatctaaaaggcagtaatagctgtgctgttcagcaaaagtggatgggaggattccaaggcagataattcagctggacccaaatagtctccacatagaagagttttaaggttatctatctaaaccaacagaactgctccctctgcccttggcctcgccatacattgcagaaactcttcccagtcttcctgccagaagattccagtgtccacatgatttctctccacttctttggagggtcccttccactgatagcttaaagtgtcagcaagagtttcctttcactgaaccacagttatttccttgaagcttcaacccactagctctagttctctactgtaagcaaaggagactaattctactacaatttccggatggcagtcctttaaaactctgaagccagttcttgggtcactccttatgagtctcctctagggaaacatttctcataagacacatagtagatatgggtgctctatttcattcaaaaatatacatatagagtcttcactctttttctccagacaggatcttgaatttgcagaatgagattctattccagggacctttatgtaaagatttatagacatttgctacaacgcattgtgcaaccttgtattttaggtcaaataagtaattgaaacaagtttctttatgtttcccctctatatagaaataattaataataatattaaattgagggtccaacatcggctaggcacagtgctgggtgtttaacataagttatcgcattttatacttcagcagctctggaactaagcagctaatgcattcaattgagagagtgtttgcatgtttcggaaattgggccttgtatcctggaaaagagctatattctacgcttcatttacacttcactcatcaaaacactctttggtaagagctatttgatgttctaggtccaactttttttttagcttttgcctttgagaggtcatgttttgcattctttgactcaatcctcaaggctctgagcctgcttaaaatgtagaaggcagataacgtttgggcttgaagtttgaaataacatttttttttccatttctcctttgggagggatattgtatttcacccacaggggttctttttacttgttgctgattttcaaaagaaaaaaagaaaagaacaaaattacaaaatccattacgtgaaggcattagaactgagtgtgaaaaacaatttagaatagaggctcccaagaatgtttgatttggagagaactagaaaatcattcttggttaaaaaaaaaaaaaagatgcagttccagtattagaataaaatcagacactaatttcttccagctaaagtacagccaagagtcaaaatgccaagtcatcatttaaaaaaacggcaaatcttagtatttctttcctggacaaaaacacctaggaagacaataaaactttacagaactgccagttttcaacatgctggcagcaaaacccagcagatgcaccaacaagaaaggcagacctaaaccagcctagcaggggcatcatttggcaaagggacagcctgccaccatactggtttctatttcagataacaaaattgtccaatagtgtctaatagagttaactcaaccagctgtgtggctgacaggcctgcacctgctttcagtatcagttctggcttctgaacagcacaggctattccagttcttctcaccgtgttaaaccacagaaaatttcccaatgcacaagttctgaaactatcttcaacgcatacgcatttgttttgctgtggctcagaagttaggcttattgaagatggaaagatggtcccagagagaacaaagtgggaacgtaaggggctcccagacccaaagctgaggaagacgacagtgaattgaaacttgccattaaggctataacagcttaatcacctggatatgatagcagcagttagacaagccacaaagagactcaactgaaagctgaagcattgtgctacaagacagctaaggggcagaagagccaacagcaacattccccacatgtgggaaggggcatatgtttccatttatttacagcctattgattatgcagcttttttttttttttttttttttttttttttttttttttttttttttaatgagacggaatctcactctttcatccaggctggagtgcagtggcgcgatctcgtctcactgcaagctccgcctcccgggttcacgccattctcctgcctcagcctccctagtagctgggactacaggcaactgccactgcacccggctaattttttgtatttttagtagagatggggtttcaccatgttagctaggatggtcttgatctcctgacctcatgatccgcccgcctcagcctccgaaagtgctgggattacaggcgtgagccaccactcccggccaactatacagaattcttaataaggcaagctgaagctgacggcaatttacaagtcagggaaataagaatcaactggtcaaggaacacatcaaaactgggaggacttgaatcaagtccaccacccttaataatagccaccttccttaagaacagcacagacctacacaactatccaaatgttctaataaaggtagaaaatacatacaaacaagtatttttctgtgaaagcagctttatggtaagattatttatcaaggccattgccccaattacttgtttctacttatttgaacagagacagtgtaatggaatcctgctcctaaaacttgtatgtttttttaaccaatggtaagagatgggactcacaactcacagttgctctgtccaatgaattgatgtaattgatgtcattgttattaatattagaagtacaccatcaatggaggtagtttaggtggtggtgacaagcactgactctggagttaaattatttgggtttgtgaactgtctctgcaacttgctacttatataaactagttgttatttcacctctttgagcctccgttttttcatctgttaaatggagatactaatggcacctacatgacaggtttgttgtgagaattagattgattaataaatagaatttagcacagtatgccagacacactctaggcacttgataaatgctaattactgtagatgtgataatacctttggttgttgttaattaatcaacatctgtacttccttcctgggattattgagagtgctgcaacaatttctcatctgccaattatttgccaactttgtcttctggagttggaggcataagagttaggtcaatctctttgtgtaatcttggttatatgatgtcacctctgtgaacattatctgtaaaattggaataatcccatgcaactcaaagaattgttatgaggattcaagattttgtatatgagtctaaaacactatataacattattgtaataattattaattatgtctaattaggagggtaataaagcaaaatgatcccatgaccccacagatcctcccaacagtcaaaagcttcatgacatgagtccttggaaaaaaagaagagaaagttgcattaaacatcacccaacttctcaagagaaccagaaattgtgagtaggagcttttcatacaccctgaatctgccggcacgtataaatcgaggtcttctcattcttccctcattttcaataccacttattgggaaggaaggtactgaaatgaaaacaatttggaaccaaaaggcacaactctcagagccacagcgatacagtgacaagtgaaatgggctttctaatagtatcctgctgcggattaacagacacctggtattccacctcggaggtggctggtgatgcagccttcttcactaggagtcaacggtccactcctagctctttttccaccatcctcccttttccaacctttcaaggcatgacctcttttccaccagttcctccccgccacccacatcccatatattaacagaagcccttcaaatatctcctccagcttttacaaggcagagatggagttggtcatttaacatatgaaaggaattttcttctggggagttaagtaagtgatgtgaggaagtgatgagcatccttttggcagctactgctccatggtgtctcttggccttcaaacacccaactttcccttttgcagaggtagcgttgcctagtggttcatagcagacactctgaagtgagaaagacccgaaactgagtctaccatgagaataagtgtttttattaccttataaacactaaaatatttcccatctcagggactttgcgcactctgctccctttggctggaatgacttttctccggctcttttcatatctgattcttcacccttcagctttcagtagaaacatcacttctgcaaagaggcaagaggtgtgttccttccatccttcacgttttccatctcagtaccccatatctgcccttcacaggagccataatatagtgcaattattttatgtatttgattccttactcatttttgtttaaattccctatgagattataaccccaggggtcatgctctgttgttttcactggtgtatcccctgtggggtttggcactgaacactaggtaaattcttcagatgaatggatgaatgcaattgtgactgctgtccactaacaatgtgaccttgaaaaaggcacttgactttcctaagcctcaatgttcttacatctcaaaggaggataatatcgcctacctcacagctacttggaaaactggacatggaatgcaccactgttctactgcatcggttccaaaatgcacatcttttgcactttaacttttttgaaataaagatcttataatagctagactcttcagtcaaataaaatatgttaacatctcactcttatacaggacccaagttcttctaactttttaaaaacttcctttggaaagacatggttgtgtggttggatgtgtgtatttactgtttaaggaccaagtttacaccagtactcgtgcgttctgctccacaatttcaacacgtcctccctctcactccccgcctagagattgctccttctgcactctcttaatgagactgtcgttgtacatttttaaaaattttattctcaaaagccccagggagttggaataatgaaacatacttaattaagctatgcaaagcaatcctgccatctaggtggcattttttgttctattttccttggttattccgagaattatattattatataagagccagcattcatagatcacttactgtgggccaggtactgagctaaatgttttacatgctttatttaattctcacaaactcccccactgtgagtggggaccagcattatttctattttactgatgacaaaaatgaagctcagatatatttagttgcttgctcaaagtctcacagctaataagtggcagaaaaagctgaaatttgattccaaagcctgtggatgtactgcagtatctccctatccacagggaatatgttccaagatccccagtggatgcctgaaactgcagatagtacagaactgtgtatgtatcatgtttcttcttacacagacatacatacctatgataaagttcatgaattaggcactgtaggagattaacaacaattattaataaaatagaacaattataacaatatgctagaataaatgatatataaatgtggtctctctcttaaaatactgtattgtatataatattttcagactatgggtaactggaatcacagaaagaaaaaccaaggataagaggggactactgtataggttcgagtcattcaaaagcgactaacatatacgaagcacaaattatgtccattgagaagttttctgtctgaaattaaagtccaaagtatcttgtgcaaaagtgtttctcaaattcttacttaaaatgtcactttgttaacattcagctttgttaaatgtaaccatgtaaattaaagggtataatacatcaactaattaacataatattatacattcactgtaaattatgcaaccaaagttcttttggttgcaatgaaaaaaaaaaaaactaacttaaacaaaattaaaccactacgggcgtttagtggttaatgtctgaaattggagcggcgcggtggctcatgcctgtaatcccagcgttttgggaagccaaaacgggcagattacttgtggtcaggagtttgaaactatcctgaccaacatgatgaaacctggtctctactaaaaatacaaaagttagccaggcgtggtggtgtgcgcctgtaatcccagctcctcaggaggccgaggcaggagaattgcttgaacccgggaggcggaggttgcagtgagcctggatcacgcccctgcactccagcctgagtgacacagtgagactccatctcaaaaaaatacatatatatctctctgaaaagatcagcgatagggtagatttcagataaagtcagatcatggctctgactcattcttcataccatgcttctcttagttcttcctcatgtataaattgcctttatcatcagcctggtttatttcatggtggaaaaatggcagcagaaattccaagtctcacatttacacacttgccatatatcatatagctcagaaatttttaatattagaccaaattagatagtgtgcccattcctgaaccaagcactgtagtgagatgcatgggattattctgattagctgtggtcaaataggacccaccaaggcctgcatggtaaggagaagagaaatggaatctggaaaggcaagtacattttgtaccaccctaggaaaagctggtgtctaacaggagatgaattgtcacagggaaaagaaaaagtgaatgaggctccagatacaacttgggcaagctcagaggtcactgcagtaccttacttccccgctaaaactctccaaagacttttcataatacttgaaacaaaattccaaactctcatcgtggtctctgaggacctagagaacttggctcctctctccaaatgcatgctcctctggctcctgccgttctgaccatcatgctgctcctcagaccctccaagcaatttcccagttccaggtctttgcccttggcagtccccaatccaaaacgctctttcctcagactgtcatattactttctcattcacttcatccaggtatctgccaaatttcaccttcccaaccattctgtctaaaataaccatccttcagtctccatccctttactctctgctccgtttctcttcccatcccatatcaatagcaaattgacattgcctgtattcatttattttctctcttctcactagaataggagctttgagcagcatgcttttttctgttttgtgcgtgactgtgtgtgtctcatacttactataaggtctcacccatagcaagtgcacaatagctgactgttgagggtaaatggatacatgaaaagacaaatgaatgaaaacgggtgaatgcatgaatgaatgaacgaatgaaagaattccaggaaattgctaggtgaacatgggtaacagatgccaggggactgtttttattctgtgtgttttgttttgttttgctttcacctcatcggctgaagacaaacaccctctcccagtcctgcattcagagttctaagaaatgctctcttttgaaagatttattaaagtcaagataaaatttaaactcaagtaaatagctaagaagtatgatggatccctcctcctgctgtcatcttttacactgaatggaaaatatttaccagtgtcttggcctccctgcatatatgtgaattgaatttttttttttttttcagatggagtcttgcttgctctgtcaccaagctggagtgcagtgacaagatctcggctcactgcaacctcgcctcccaggttcaaacgattcccctgcctcagcctcctgccgtagctgggactacaggtgcacgccaccactcccggctaatttttttgtattttagtagatggggtttcaccatgttggccagaaagctgacctcgtgatccccctgcctcggcctcccaaacttttaaaatccaggcagacaagcccattatagactggtttgcacccagtatcacaattaaatcttggtttccttctttctttctaccttttatttccttccttctgcctagtcagaattactaagattcccttgctggggattttgctcaatcctctgtagagttaatatgtatgggtcctcctcaggggtgcacgatgtctcaagggactcattccagaactaatttagagggagttgatggttctgcatttgagcttttgacgattcttataaacattttcccaggaaagactagcttctcccctttattcttctgcctgttttattattggcaatgccaaacatagatccctgtgctaatgacaataataataattagtattgatgacaacattaacattttcagaaaggttttgtagtttataaaattaatttccatcagtcacactttcatgatgaattaactctaaagacaagcaaatgtctcctacccacaagggagagatctttgtaccagcttcgcagcattggaagacgtcctcggaccgcatgaaaacacaactgaccccttttctttcccctgagaagccagagaatcagaagatcgggtgctaaagccagagaggtcatcttgatactgatcctaccactaactgagcctcggaaggtcattcttctctctgaaatctttttctcatgtgaaaatagaaataacactactacttatttcacagagatgttgtgacaataatataagatggtgcatgtgaaaatccttaacataccacctagatcagaataagtgctgtggtagcaattatcattattgacttattcaatatatatttattaagtgtctacactatgctgggtgctggtgcacaaaagtaaaatggacaaggttcctggaattcatcatcatcttcatcaatcatgatcaccttattattaataaccacaaagaacctagaaggtgtagtggaagcaatgcacctaggtgtgggagaaagaaaaactgtgcttctgtcatgcctttgccatgagccagacagcaaaacattaaccctgtctctttggggcctcaatttcctcatctgtaacataacacagagaagtaatttattttgattttgtaaaaccagttgaaaatacgttgttacaactaataatatattttatcattttgaggcaaattttataaattattaaaaacataaaaaagagaaattagactttgatctaatttaaagcagactcattatcatcactcatttgccgtctaatctttcttaagtggaagaaaagggttggagctaccacttacatcctagggagtgtgatgatattgcaaaagcacccagaagcctgctttgtacaaaggagaaaaataattacaagttaatggcctaagtgatctccagcatccctgcctgctctgacatcatgaaatacaattccagattattgtaaccaacaccatcaatctgcagatttaaaaaaaaaaaaggagaatcagaaaagttaagaatcttaacaaagattacaaccatatgcaggagcaagctaggattaaaacccaatgtcttaaatcttagtttgggtcctatttccactacctcataaaaactcggatgaaggcagggaatgtggcttgcctgagaattacatccacgcccatctggacccagttttctattatttttattaggaaacacattcttcatgccctcatacccacaaacctctctgtagacatcaattcctgactgttctgagcagcaactaaccaagcaaagagccaaatgtccctgtgacttggttaactgaagatggaccgcatgcctgagtgaagaacagtttcccaaagaggcttggatttctgccaagggacaacttgagtaaagagtcgtttttatttattcttttacccataggttatttagaagtttgttatttagtgtgcaaacatttggggaatttctggagatctttcagttattagattctaattaatttcaaagtggtcacagaaatactttgtgttagtgaatccttttaaatatactaaaacttgttttatggcctagaatatgatatatcctcataaattttctgtatacatttgaaaaatgtgtgttctgttgttgggtggagtgttccacaagcaaatattaggtcaacttggttgtgacattgttaaaatcatctgtatctttactaactttgctcgttctagcaattattaagagtattgaaatctcctactataattatgaatttatttccccttgcagttgcatcagttttgcttcattattttgaagctatactagatgcatagtttgatctttttgatgaattgactcatttatcataatgaaatggcaatatttaatgccaaaaatcttcatgatctgaaatctacttagtgtcttattaatacagccagtccagttttttaaaattagtattagtgtgtacatatttttccatatttcaactttcaacctatttatgcttttatatttaaagtgggtttcttatgggcaccttagagttggttcttgctttgtgatgtttatactatttacatgtaatgtgattattaatacagtaggtttaaacctatcatcttgctatttgttctatctaatctttgttctctttttcctttctacttaccttcttttgataagttgaatattttttatcattctgttttatttcctttgtggcttattagccagagcattggggtttttttaatgttagtggtttgtttagagtttatagtatatattttaaatttatcatggttatcttcaagtgatgttataccactatactacgtaagtataccataagaccttcaaatagtatactttgatttccctgctaatctttgtgctattgttgtcatatttacttttaacaacctattaacctcatgctacattgttagtatttttgttttaaaagtaatttatcttttaaaatgatttcattgtttaaaaatcctcatgtgaggctgggcatggtggctcacgtctgtaatcccagcactttgggaggccaaggtgggtggatcacttgaggccaggagttcgagaccagcctggccaacatggtgagacctcatctctactaaaaatacaaaaattagccgggcttggtggcatgtgcctgtaatcccagctactcaggaggctgaggcaggagaaggtggaggttgtagtgagccgagattgcaccactgcactccagcctgggcagcagagtgagacttggtctcaaaaaaaaaaaaaaaaaaaaaaaaaaaaacaaaaacctcatgcgtttaacaatctagtttttgtttaattgcttttcattcttttgtgatgatccatattctgtttggtattactttctttctccctgaagaacttcatttaatatttttttgtaatgcagatctgctgctaattcttccagttattctattctaaaaagtatttcattttcactgtggaaagatattattactgtgcaaagaattctaagtttacattgttttctttcagtacaaaatatctttctgcattcttttctaacctgtattgtttccgacgagaagtcggctgacatcttttttcactctgacagctttcaactgtggtatatctttttagctgatatatctttaaaactgattttgagaaatttgattatgctatgtcttcatatttctcattctcaggatttaagttttttgaactgagggtttatagttttcattaaatttgaaaatttttcattccattatttttccaaaattcttcctgcccccttttacttcagggattcaaattaaacatatattaaaatcctcagtcgtgctcaatgcatagttcaattgtgttttctctaagagtttcatttggggaaattactttgttttcaagttcactgatttttttcttcttcaatgtcaaacctgccattaatccatccagtgtagtttttatctcatgcattgtagattttatatctagtagtttgatatggttctttaaaaaacattctctatgtctccacttgaatttttgaacctatgaagttgagagttagagttactctctatagtaatagccccatgtgccaattccaacattcatttaaatctgggtaagttgttacatgatattttttcattatggattatatttccctgctgctttgcatgcctggtaacttttgatgggatggaagaaattataaattttaacttttttcgtgctgatatttttgtattactataaatatcactgagctctgttctagagtgactaagttacttggaaacagtttgatcttttcaaattttgcttttgatatttgttaggcagagtgagagcaattcatagtctacagctaattatttctccattattgagacaacccccttctgtgtactcaactcagtgcccatgaataactgggttttctagtctgactagcggctaaccctcactccacgtgagtcctgggctctgttattttcaatctttgggaggcttctttctttggctttaggtagtgtcctcacccttatgttgagcagtattcagctcaacactaaggtgggccttaggcagatctccatttacgcggatcacttttctcaggtactctctcctatgaaatccagctgcttttgtttcctagattcaactttgtctctgccattcagggagtctgccacacttgaatcccctatccttaagttgcagcctggaaactctctcaaggtggtgagtggagccataaataaaatgtggtaaactcacttattttagtttctatcttcttttccccaatattcagggtcttaaaaacaatcatttcaaattttttgtccattttggttgtttcagtctgtaggggatattacagtccatcttggtctgaagtagcagtcaatagaatggaattcattgaaggtaaataagaccattaaatctctcaaacatatctccaagtagttagaatttacaaaccccaaatttatttttaaagcaaatattgaaacccccagtatgactaagaaaaagaaagcagattggaaccaaatactttactacgttaaatgacacattggaaattttcaagacaatttcttaagcaagtaatacgggttccatccggctccatcatttgccattcacttgacaaatgtcataacgccactgcacaccccaccagagcaaatattttcttccaaccttaaaataacatctacaaattaattcagtctgtcaaggggaactctccttgggtaattcaggaagtttttgcctttgggtaaggcactctaggcacaaacaactcaaattctcacctgtaagttgaaccaagaaggaggtttatgatctacagctacatgaaatgatcacttagtcgcagatgactatgtaccagacacacccagctgtaattttgaaagccaagttcattttactttgttttgagaaaatgtgggcaaaagattagaggcgcctctccaatcttgggaagcctctagtcatggaaaatcatatcccagcagtgctttatatgatttcacctgcagctttaagtaagaatgtttgaccagtaatgctgtaagcatataggataagagagacctatgttgtacacacttccagttgtgctaactcaggtatgaagatctctggaggtgagctatcaaaactccctgttattgctcattctaatatctgccaatcttaataatcatcaagttcttgttttggaaataaatacacataatgatgattatgataaaaataataaaaatgagtacaagacaacctgggataaaatactttaaaaagccctggaggtaacatggataaataaaccaacccaggtggggactaaggtgtactgcgcagagatgacagtcacttccagcttccagttgatcattagcaggtcaggatatgggattattatcactaactccatctttttcatggtaaacaaaaaatataatttttgtgaaatctgatgatagtgtttaaacattgggactttacttttggaaacaggaaaaacactctaagtttaaaaaaaaaaaacatgcacacaacacaggtcaatttgcagcctctgaaagtcgtaacgtggggtttggaaccaaaggaaactggatttaacttctggctccattttacattacctgtgtggctcttttcaagttctataacttctctagtcctgtttacttatctgtaatatgaatcatgatttttaattgacctgctggtactctagcattcatttacctctttctcattgttaacagaactcaaattttattgagacttcatgcctcctgtaagaatctatggaactcaagggaagtttaccccattcccagctccaggagtaggtctggtttgatttaacctatttgccttctctgtgactgggtcaggagtttggagttaagccagtcagtacctggcattttcaaaatcaccattattggcccaagatgggtacatgacctaatttggccacaaagaagtcttcccaggtgttaccagcaaacttgaggtaacgaggaagtcagttagagaaaaaaaatcacactgcccaaaaagcagagtcaagagatcatagagaaaagaactagaagcttgattatattgcacctgaagtccaaacttcttctggaatttttgttacgggaactaattcaatcacataactttgagttaacttgattgctacctgcagtaaaaacatcctaactcacatctaaggatgaaagataatatatttaaacagattgacacataggaggaagtcaatacatggtaggtcttacccttagagtactttcacgtttaaaaatatatatgcttagataatataacctatgaaacttgaagtttccccactcaccctcacatacataatgatgcgttgattaaattaaattgtttaaacttcctcttattaatagtgatggaaatgaaaaggaaatgagcacatttctcaggagagctattttctatcacatggaaaactgggcagtgtggatttactctttgtgtttggccaggacttaaccaaatgaagcagatcctcaggaagctgactgtggggatttggacaatggtacaccagacaccagcagatctgccagttcatttacccaactttgaggcccatgtagaaatgtggctggcctcccatgcccacgcagaacacagctagcaccatcacgctggaccgtgactcctccatccctaagattcatgccaggatttgaggcaccaggaacctggacgggggctcattcacacctgcaggcaggcagcatccacatggaagcaagaggtgagagaagcaaagaagcaaggagacaaaggcagagaacaggtggagaggcccgttctgcctctcttgctcccacctggaagggatgatcaggagagcttttggcctatatatagatagaggtgcatagacagatactctttcaggaaagcaaaccaacgatagctcataagttaatcggtcgtgagcacctgcccctttatactttgctgcatgcttctcccttttggtagaaaggatttttaactttgtctttttgtacaatatcagatgttgcccaaatcgtgtccagaatgaaacaaaaacagaggttttccccctgcctgaactatcactccctcatctctccagaccccaaaagctccatcgcctcctcatctctccagatccaaagttccatcactcgtcacttactcatctgtccagaccaaagctctatcacctcctcatctctccagactcaaagccccatcacctcctcatctgtccagatctaaagttccattaccttcttatctctccagacccaatgctccaccacccatcacctccctcatccgtcgagacccaaagcttcatcacttccttatctctccaaagccaaaacttgacttgccatactttctcaatgtactgattaaataaaactgccggtaggattaactctgcaaggatgcacccaacccagatatattcaccatagccatagattacacatttttggaaggcctactacgatgtctatcatggagcaaacactgtgcagacgcccaccaggcatcaaaacaaaatcaacattgggaacagagtctccatgtgggaagagcacctggaatttacagcgtaactctttctctccaacattctcctttcccttggaggattatttaccaattaatgttaaagttcctcatggtttaaacccaggccctcctgagtcatcattctcccctgcaagaccttgcccagtcgtagggctttgactgccatcaataagctcaaatcctgtgtattgcattttcggtttgtactcagactcttctctctgattgcctactgagatttccacttggatatctcaaaagtatgtctaatttaacatgtctaaaattggatgtccctgactctctgttccccaacatttctttcctcatttcttctgtttagtaaaagacaccaccatctactcagctatacaagaggaaaattattattatagctcttttaacacctcatattcatctgtcaagtcttgtcaattttatagcccaaatatgcattaagcctgcccacttctctctgaatccacagctattactgtaatgcaagtcaccacttcctctttcctagacctgtgctatgatctcccaaccagcctatgtttctacacattaaagcctcccagccccagtatacactctgttagcaggcatcagagtaatagagatggggcttaatttgctttgttttttcacaaaagagagtggcaacaaataattagcacatgtcaccaaattactaaatttcaaaatgaaaacttctctagtattcatccctggaggaaatagatcaatgtgcctttttgttcggcattctggttccaaaatcctaagacttacatctggcctaaggcaaatgtgaacaatatttgtgctttatgtgtgaccccaaaacaacccaaaccacctttccctcaaggtaaaggcacggccaacttctggtcctcccaagctgccagcatcaggtttctaccatttgtcgagctattcattgggtgccaattggaaatgattgacttgcattgcagggctggcatacggttcttttgacttccagccataaaagggagggctgtgttccaggagagatgccacaaacagagatgatgctgaagagaggctgttgacttagtgctcaggctgaacacccagcaagctcagcccactctcatgggtccatcaggcctagatcaagctgtgcctctagtccaggagaggaggagaattaacacctgtagagtgccgactatatcctagatgcttgactaagcacaatacctgcatttaagtggtatcatcctccctattcttggaattttctctgtttacaatcaaggaaatggaggctcaaagaagttaaggaactctcccagaataacccagataataagagggtttgaacacagcactgtctaagtctacattccacaaagtcacatagctttgggaaaaatgatttgtgttcctctggattctctcacctcgtatctcttgctgatttactttgagactcagctgtttttcccacttctgagttcagagtcccaatcagatgtacagcaaaggcccacaggacagcttggcctctgaggtgcctgatttcactgcgagaagtgtttgttgagcatatggtgatctcccagataaatatttgcaaagagttaatcacattcacctagggaagttttaactctggtcaagctcagagaattaactgagcaggcatttctattggcattacaaaaaaccaacagtgatcattctgattactaaataaaaatatgtcaaccaggtttagcacagtctcttaatgggtcattaaaccaagaatttttcctatgttattttagaaatgaagatttaaagtagtatcaatgtaacttagacatgaataaaactctttctcacatatatatcttccttctatttccctttctgcaggggtaataatttacaatgttgttggtttttaaagctgaagcctgacttcataactcaagaagtcaatccaaaacacataaatggtcatgccaggtgtcatcaatgaaggccaaataacttcccttcaatactaattcataactctcctgggataagactttttttgccccctcatttgtgctatagatctacttgagctcttctacttgatttccagtgcagtaacttctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgacctgatagttatttgtaaaatgccttctccatgcctggcaccatgctaaatgtatatactttaagatgttacaagaagaagagatgtctatcttacacacgcaccctctttaggaaaactcctgggttcacagttgttaataacttatacttggtaaatatgtggtaaattcatagtcaagtctgtcatactacctagaccatgaagttttcttgatgccacactgccctcttcccaatggccatatttctcccaaggtaatcctttggtaagagggttttggtctgaaaaacatccaccctctcccttctatgacctcctcttcagtaagtgtaaaatgtgtcccctccgctgtggaataagaaacacatatatgcatgcagagagaaagacacacacacacgcacacaaaaatgcaggtaaacgtgtgcacatgtgtgtatatacatacccatgtacatatatgtgtgcaaaaacacctgtagacattcacaaacacacagcactcacagcacaaacttaatgctttgcatttcataaaaccacaggctaaaatgtgatatgaatttcacctgggtctatatgcttgaaccaagccccaaataggcattagtggctagagctttaagcaccagaggaaataaataaaagctaccaaaaagcagcttggaaaataatcacagagcattgagtcacccagatcctactcctcttgttaggtgctgtgctttagcataaggacatttttctttctcctatacctccaacttgggaggctgggcctctactatggaatattccactggcccccaaacctcagagcaaacaatagatgaatgacagccctgccccgcctgataatcacatgatggcctttttgtgtctctccaactatgaataattggtgcttagcttatgtaagacaccaaagacattttttgaatgaacaaatggtaatatcatgggctatggcatgaagagacacttacttcactcataactttatttcatttttattttattttattttttttgagagactgggtcttgctctgtcgcccaggctggaatgcagtgacgtgatctcagctcactgcaacctccacctcccaggttcaagtgattctcctgcctcagcttcccaagtagctgggactacaggcgtgcaccaccacacccagctaaagtttgtattttttttttttagtagagatagggttttaccatgtgttggccaggctggtcgaactcctgacctcaagtgatctgcctgcctcagcctcccaaagtgctgggattacaagtatgagccaccacgcccggcctaataactttagatctacaagtttcatccatagtagtaaccatttacagactgcttttccatacgccacacactggtctaagatgcaaatgcttttcttgtccccatattacacctgagggagccgacgtggagttcagtgactcacccaaggtccgaagtctaaaaaagtacagattaggttcgaacccatgcaacctggccccagtgcccatgctcttaaccgtgatgccactgcctcccagggggccctggccactcctgaactggacagattcttgtgatggaaccggacacaacagccgggattccaccagccaaacaggtcatggtttaccttcacaattttgggagttaacagtgacatggtctgtgcttggtgaaggaacagatgtttaataactgtgcagtagcaaggaggttatataacatggctgagctatttttaaactttggaaaatgctgactgctcttttcaaagtgtcttctgtaaaatcaggaatattaaacatgaagaaaatgtccccctttcctgtacttttttttgcctgaaactctatgtacagaaacggttgggtgtaaggtcatgaacataccttcccttgcaagcagcccctggtaccacgcccagcccatgagcaacaatatcctaactgcaccagctctttgcctgagattataaataaagtccatgaggaccaccaagtggcatgtctagctggccccatgactttgttctcaaccagtcaaatctggatcccagatcccctcagtaactcaccacgaagatatcaggtatgacctcatctgaacttcttctggagctatttgcaacctccctgctacataggaggaatagtgagagctatttgtttatcagatgctttgcagagtaagaccttaatccagctgcaaatgtaatttttaagcttgaagtgaagaactcctaactccagagtcctgggcttctattgaacaagctggtagatctaacacaggctacagataggtctgttctctgctttcagctatccagactgaaaaatatcttactataaaaaaacctaaatgtccatcaaagaggaattatgtaagtgtaaagatggaacacttatacaacagaatatcatcaataaaataaatgcaattgaattatcttcatagagggattttgaaaacataaggttgaggtaaaggaagttctaacacattagacaccatttttgtacgttagacagaagtatgcattgggaatacggttgcacatgtatgtgtattgaaagtacgaacacatgtacatggatttggatgtaaaccaaactgattatcatgttttcccttctatggagagaacaggagaaaactgggacagggaaacagatagaatcagaacttctacattatcattaatgttttattgctttcaaaatgttgaaacaaacattaacctttggcaggtttagctttgttccctatgatgaatatcgggttgagtattttatcagattctgttgttttctgtactattcttttttcaatattaaaaaaagaattcttattcctaagtttgtctttagataaatttcccccaccttgatcagactgtatggtgtttgaggagagaaattatatcttaattcatctatgtatcccaggggctagcacagagtctgttggttggaagcaatgatagacagaggatagaatatagtgccttgaccaggtgtggtggctcatgcctgtaatcccagcactttgggaggccaaggcgggtggatcacctgaggtcaccagtttgagaccagcctagacaacatggtgaaacctcgtctctactaaaaatacaaaaattagccaaatgtggtagtgcgcacctgtagtcccagttacttaggagggtggggcgggagaattgcttaatccaggaggcagaggttgtagtgagccgagattgtgccacagcactccagtctgggagacagagcgagactctgtctaaaaaaaaaaaaaaaaaaaaaaaaaaaggagatataatcctttttgtttttttgtttttaaatgctttctttggcctttctctagctccctgtcaagggcagcctggcaggtttccactattccctggggtgggcgtcagggaccgtgggagagtgtgggaaggagagactgcttgtgccttatccaaacttacacactgggtggacaccaccagccctgcatggatggagagatgtttcattaaacaccaagcagtggatggcgacttaccacgcttgatgcattgcttctctggggctgaaataccatttacaaaattactgtgtttaaaggcgtaactttgggaaattgcgcaacagcatttcacagcagcagaattttttaaaaaaagcatagaatccagggtggtcactggaaagggatctaaatgtcttgccaattatccttctagaattccttttcctgtatatgttatatttcaattgccctaaaattgatttatgtttccatcaaaattatatgtttctgaatattccagctgcagggcacatattatgatggaagtgagaattcattagcctcgtttgtgtctttgggctggcagcaatcctgcctctgtaagagactcccatgtctcatgctgatttatctgagttccttcctgatatctggacaattatttaaaatgctgaaagtggcagtgtagaaacaggattactaaagagagtaaaaggacagaggacggagaaatgtcaaaggagcatgatttcttaattcaaggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggtaataaaccaacatggtttgttgactgtatttcccttttattattattatttttttgagatggaatctcactctgtcacccaggctgaagtgcagtggtgcgatctcagctcactgcaacctctgcctctccctcttgggttcaagtgattctcctgcctcagcctcatgagtagctgggatcacaggcatgctctaccacacctggctaacatttgtatttttagtatagacagggtttcaccatgttgaccaggctggtctcaaactcctggcctccagcgatccacccacctcggcctcccaaagtgctaggattacaggcatgagctaccacacccagcctgctgactgtaatttctgatgaccaaaaacttcactgatcactctggaagttatttagtattactatgtggtaaataccgtgctaaacagtacttttcatgcggcacctcaatgaatatgacaatctctagaacattggtcctcaaagcacagcccctagaccaagaacatcaacatcacccaaaaacttgaaagaaattgcaaattctctgggctcaccccatattttctattacattagaaactctgagattgaggcccagtaatttgtgtcttaacaagtcctcccagagattctgatgcctgctgaggcttgagaaccactgcctagaaattaggtgctattatcatcactttgcaataaacacctgaggcccagaaaagtaaaatgatgtgcaagtcatacagaaagtggacgagacaagctttgaacccagacaagtctaactccagagttgaggcccttaatcacagttctacactgctcattatctgaggaataaagcgtggattaaatcagtgaacatcaggcaaaaccatgcaaaattgggataggagtgatcattctaaatctcaacagctgaaccataatgatgggccacaaggaacaatgacacttctcagaaacctaaaatttaacttaaatgttcgccaagatgggagtagctaaataaattatgatacattcacataatggaatataatgcggttctgtgagtaatgtttgccaagatttccaatggcctacaaaaatacttagaatataagaagggaaaaaatcaaatgcaaaatcaaacagagaccaggagcactagtgtgggaagtttccccaaagcgtaacatgttggtgaggatgtgggaaactgggtagtttcacaaactgttgttgtgactataaattggtgttgttactttgcaggacaatctggcaatagatgcttccatttaaaaatgcacatgaattaggacccaaaaatcctatatcttagaatcaaccctagaaaaaacacttgcacatgtgcttagacatgtataaagattatcacagctgtttagcttctaataggaagcttcaaaatccctaaattaaatgtttataagacaaatgatgaattcttgaggtgatgaaaaccccatttaccctgatgtgattatcaaacattgtatgcctgtaccaaaatacttcacttatcccataaataaacacatttttgtattgggggttggggcgggaggtggggatgatcaatagggtaaaaaaaaacatagaaagaatgaataagacctactatacgatagcataatagggtgactatagtcaataataaatgacttgtgtattttaacataaagaatataattgaattgtttgtaactgaaagaataaatgcttaggggatggataccccattctccatgacgtgcttatttcacactgcacgcctgtgtcaaaacatctcatgtaccccataaatatatatacctactatgtacccacaaaatttttttaaataaaagaaaattaactcgtaaattcctaccattatgcagactggataactaaatcatgataccatgatatcatagtgaagaatgtgatgagggctatgaggttagacttatctgggttcaaatctttatgagttacaaaaaatatagatacacttgagatacagccatagacagacagacagatcgatcaatcccaggtgtaggtttccaagatatattgttgagtagaaaaaaaagttaagttgcaggaaacaaagtctaatgtgacttttcttacaaaggagatgaaagaaagagagaggagagcaaaataaaagtcccgtaagtaaacacataacattctgcattttcagtgcgtatttccaacaatgagtatgtaagcaagcaaacaatgacaacagcaaaactctgatcccactttgggagacaacaagccctttcttacgggtgcaaggtgtgcatcgggacctctggcctctccatctgcccgtagcagctggccttggcctcggggatgtaggagaacttctccagcatagaagatgcagcggtggttaggatgccaatgccgtccctcactctcgcctccaggctgtagtcccagtcatcgtaggagacagaaatgagtcccgatggaaactcttttgggatgagctccgtgttcccagagaccaagctggggacaatccagaagaaatcatacccggtgaggccaagggagcgggcctcactcagaatgagaacagcctcgtctttggaacagtagagcaagatgacagaagagtggatcttcttcagctggacttgtgtctttgcatcctcaaaggaagtgtccagtgtgatcacattctgcatgtcccagcccacaaagctgttgtccactgtggtcttgacgaagctgatgaattccctgtagccagggaagatagtggtcaccagggagaagacatgccagtcataatcctgcatgatcttcagcatgaccgtggcttgctgctggatggacgctccaaactggaagaaggtagacgtcggatcctgccagtgaaaagaaagtaaaacagaggatgaggcaggaggtggtttatatagaagcacaaactgcgtcctagaagtaaggaaagtaaatcacacatcaatcatttgcagacattcctgagcatctactatatcccagactccagaacagatcctgcaaatacagagaggacagaagcccctgtactcaggagctcatagccaggtcctggaaggatgtctgtaattattgcttgcttatcatctattcttctcattttcctctagttcgtcctgccccttcctcctttgagtctatatggttctaacagaacaaactctatctgacccccaccccagctcatgaccggaaaatcaagccacggaaataaaacagcatcagcaaagacagttttctaacgatatatttggagcccctagagtctgccaagtatgaagccatttctcctggacccctttgttatacaagccagtgagtttctatgttcatttaaggagtttgagtagggtttctgtcacttgaacatacggctcccacataatacagagtatcataaataccatgtggacatctaccttttcaatcaacaaatatttatcgaacaccttattaagtgttcttaataagaattaagtggaagacaacttctacaaactaagagctaaaagaggtatatgaagtgctgaaggagaatccaggtgaggaagaggagaagtgcatggatgttacagtcagaggaatcccgaggatgcactgcgactatctcagaagctgtagatgaatgcatcatggcaccgaaaggaggcggacgatacgatgttgaagagcttggcagaaatccaagcacatagggcctattcagagcataagggagagtcactgaatgctctcaccctagaaagtggcatggtaacttatgtcaggttaaagggcctctattagccctaacatctccacccatctacgattgtgagaacaaatttccatttagaaaaggcaggtgatgcatacagtggtacaatatacaaactgccttcataccccctaactcatcaaatccccataatgatcctacaaagttggtattgctggcagggaaaacgaggctcaaaacagtcacagagcaagtagacatctgtacctcagtgccatgactctgcatcctgccccctttctgacactcaatcacagtcttcctgggatcactgaagatctgtatggaacagatgcttaaaccacgttgttgacttgtggacatggtgcaaaaatgccaactaaacagaaggtatgcctctgtgttagagcaaaacaggatttgagaagtgctgagatgtatttctttcagggaactgaaagaattatcaaaaggtcctcatcatattacagccatgtttttattttgcgttctgtatttaccatgagtattgaacacaacctcaacaagataacttatggggattccactgagagagagagagagagagagagaaagagagagagagagagagagtgtgtgtgtgtgtgtgtgtgtgtgaaaggtggatgttccattcatgtttttcagaacaatactttgtagctgtgcatgtcaattccttcaacaagtttacatcactttccctgtgggtgctcactaaaagttctatcagaatgggccaaaagctatagttcttcgaaatactgctcttttctgaaatgcatgggtttgggggataatttgagtgaagcatggcctgaaggcagagaagaaacaagaataaatgtcttctgggccccttccaacattgcagttccatgaattttacctaattaaattaattaaagtgggtaatagatttaaagactttggataattattgttttccctacagtagcttttgcagaaatctaatattcttgaattgattaaccattttaaatcacatctcaacaagactgtgagctcctcaagggcagagatttttgttgttttcatctttatgtccccagaacctggcagaagtcttggcacacccataagtggatgacaagggaatgaagatgtgaatgaagcctaaaggactgtccttggttaagaccagaaatggaaagaatgggaattcagtatctgagattgtattttgtgtggattctgaatattgtgtccaaaacaaaacaaaacaaaaccttcaagatcatcacctacaccttcctaccctgaggaactacccaaccatccaatacccaacctatatctcaatgtatcctttattgataaagaggagaatatagaagacctataaacctcagcagttgtccacagaacttcattaatgccaaaatagggcaacaagataaaaaaaaccaccaacagaagacaacacagaagtagagtctaaaggcaattatattcgccaacctcacacactgtgagacgcctcttgggatggggcaaaaatgttctaaattacaaaagaaatgtgatagctcccatgtaaatgatgcctcaaaggaagccagtcaccagagttaccttctgactgcaaaaggtggtggatcagcatcttgcactaagtacacaaggaatacagaaagctctcaacaagacacacgctaaaggcaccattggaacctaataaaaagggtctatgagacacttccttgggaagattggtactggtggagaggtggaggtcagacatgccagatggtgatggaatgtgggatcctccaacacccttgctctatgtactctgagctagacatgaccagggtacccatgaaaaggtctgtgcacagagcaaagctgtaagcacacgcatcttatctggttctctacatgtagagaggaaggcatggctgcactgtgaacttcctcaggagaaagataattggagggacagcagttaattggcccagagccagctcggcacaggccatctgtgaaagagtaggtgcaaaaacccttgctttgtgctgtctccaccccctgtcatgccaaacttcagcccaagctgaatctctcccattacccactatgctgatccccattcgcagcctctctgcagaaaatggagaatactagaacctctggggttggactacccagctccaatcctcattatgtggccttggatgggggggaaaaaaaacactcagcctttctaagtctcagttttctcatctataaaatgggtgtggctatggtaataatgatcatagtaaacatgctagaaatacttactctatgagagtcacgttgctcctcactttctaggtgctatctcatttaatgccacccccaaccaccttattaagttggcactaatagtatgcccattttacaaatgaaaaaagacccagaagtagggtgatttttccaggttcgtacaggtagaaaatcaggtttgcctgccctcagggtctcgagtttttacctctgcactctgctgttgccaataatggtgcttcctcattaagttgtaggaattaaatgattctcttgtatcaaaacacccagtgtagtgcccatcaagtatgaagtattcagcaaatatttcacatcaggagatcatgctatcttttgcaagaggtaatccacactctggacttggagcatctcaacaactcaccctgttcagagctgcctggttgaaactcttaaagcacccctttaaccatgccactgccctgctctatagtcatcaatagctcccataggcctaccatgttaagttcagactccctagcctacccatctatgtgcaccagctttatagttgaaataccatgagctctagggtctattgaacctaaattcaagtcctgcctctgagggactgtggctaacctagccagccccgtggctttgaaaaagtgcttaatctttctgggcctgagtttctttacctataagataggaataatgacccttccatcacatgggtctgctgtgagaatgggatgaaaaggtagaagtgggagactcatctgtccacgcctgactttgacagtttgggtgcttgtctccacatcctcggtcctacagaccacacagacatcgtcagaaacctaagagggtcctcatcctatttcaagaactggcctctccaggtccactgacatgctggtttcaaatccccaccaccccatgcaaaccagctcattcattctgagcccaaggagcctgtataatgcaaagaagaaactgcctttccatacagcaatgaatccatgctttggagagaaaccatccctaatgtccttcctgggcatcatgcagttaccctgtactactgtcatttctattggtatcttaaaattcaacccaaaaaccaccatggaccaaaagcatcatctaccccttggagggacagaagcaagggcctatttgcaaaatataattgcatagcagagcaatgaagaggctcacatttaactttgggatttcctaaggtgattttatgaactggcaggacatgatggggaatctggccacactcccagggcctggcgtccaatatgccaaatagcccaaagcccctgaacatcctttccactccctgtcttgatggtagaggccacctctcctgcacttacctcctcctgccatggctcagcctgtatttttcggattctacatatcagcctctgaccacctctggcactcggcttccttagaatgtgcagctgggggagaggaacagatttcatacacccactttggttctgaagcaaaagcacttctctccccatgctcactgctctgcggaagacagaacaaactgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctcggtccccagggtgacacctgactccatgggtaccaaagcctggtgtttcctagagcataatagcaacttacattccatttacccattcataaaggttacaaagcccatccacacccattatctctttgatcctaactactcaagagataacgcaagtggcataacactcatggatggcatttctcctaaagacacaggatgagaggttaaatgacttccctgagatctacatggccccatggtgatggcagctcagtcatcgtgagatgcatccagttttcccttgctcacatcagtggctctcattcctggctgcacatatgaatcccttgaagagttatcaaagaataacctatgcattgtgccccatgcaagtctgattgaaagggaatctctgtggcctgagtatctgaactttaaagctgatttattagtttttcctctgtctcttctcaacagcagtatggttgagaagtaggtattcaagttagtatctttaaagccaagtacaatgtctgacacacactaggggcctgataagtacttggggaaggatgagaggggcaggaggcttacacccaagaagcatgagagaattggtcactattgtcaaccccacacccatttccacaacttattttcctgctgtctgccaagaaaaggaaataatggaggtaactcagcaacgatccagagagactcctggggaatttgcattctcctgttgaggactgcccttgtgagccctggtaagccctgatgtgctttctgttactctcatagtgtatcaactgagcatttcaacatattttatttcaatttccaggggtgagaggaaaagtaaaaacatcaaataagcctggtaagcctgaggattcagatggatagcattctcacgtgcacataagctgaattggtcacactggaaaacaactactccaccaccacccacctccctcccccttcctctgtcatcatcatcctccatcatcatcacatccatcctcctcctcctcaccatcatcatcatgaccatcatcatagccaatatctctcttgggcatatccaatatgtagctctatatagcatacagtgggatgtcttattattatccctgcattaaagattttaatctggatcgtatgtggttgcctagttgcggagaggtgtgaatcttgcatgtccttcagactgacaattcttgagggtagggcaccgtgccctcctgacttctgctcagcaccttgcagactgctggaccacttctttgagaaggaaactggcacaagcatcccccctagagtgcaagactgcccgtgggcaggaaaggatcccatgctctatgtacttaagcagacctgccagacctaccactctagaaagagacattcatccgtggattgtctttcattcattcaacaaatttaacaaactccagctctgtaccaggcattgttccaggaaagtgaatctagggaaggaggctaccaaagtgaaggaccctgattccatgaattttacattcttaggggaggagacaaacaaagaaggacatcaataaatagaacaattggccgggtatggtggctcatgcctgtaatcccagcactttgggaggccaaggaagaaggatagcttgaggccaggagtttgaaaccagtctggccaaccccagagtaagacccatctcaaattttaaaaatttgaataaaacaaaatagaataatttcaaggaaatcaaatgatgtcatagttcaggagtggggtggagagaggagccccactctaggtcatctgatctgctacattggagctgatcaaaatgatatgaagaaggagtcatccaggcaaagattaggggcgagatgagagtagggagagccattccagcagaagacacatatgccaaggtaagcgagggttcgtcaagttcagggaacagaaggaaagtcagaacagctgaagtttaaggagcaagagagagtggtgagacatgagttaggacaggaagcaaaggccacatcacacaatgaatgccctgtagtcaggatagggagtctgtatctaattcctaggtcaactgtattgcaaacaactcctctgctaaatgtgccaccagtgtctcccaatagggaacctgggagaaacctggaatttgggggattttgtgtaagataaccctgttcttccctctggaattctgatctgtgccaataggtaagcctacattgactaacatagaagggctgtcatacatagaggggttgctgctgaactgaaggaagcagctttatttctggaataaaaaggagtctttcaggctttcccataacacttgctaggttatgacttgaaagatgcagccagcatctttcgtttgctatatcatttagtcaactggtactctaacttcaaatattgtggctagaacttccatgttttcctgggaatttcagaccttgtcccagtttaccacccagagccaagtttcccactatcaagtccacaatgccagaggaaagaacacataaatgcatggagaaatgtatttcttgattctcgttgcagctgatttaggacagcccaatatactgtacattaattaggaccacacaatgatcattgctcttgaactcagccctgctttctagatcattagcagggctggccaaaaggaggccctgctgagattcagacccttattgttatgcaaggaaacagcaaagacccaagctggctttacctggtgctctgtcaacatgcaggtgagcatctgactccacgcttccaaacagggtcattagcaattatggattgtctggggctaggtccagctaatctcacacagaaagcaagcctgattcccactaaagccagagggaaatcctactggaccagagaccatggggttgggtctctgaggagctgataaacttaagcacaaggaaacagctttattttgcaagtcccaactgtgactgggcccctggccttctctgtgcctctgaaactattttcttcagatcccttttttttcatgaagcatgggcctccctgagccacctggtggatattttttattctgaccactgagcatctgttcttcctttactggtaatagtgaattccccctgagagccctcattttcctctctctcagtcaagccaattggcccatagtgccagtaattaattcgggggtggaacatttcctaatctgatctaatcagagtggctttctggatttatgaagaaagggactaggaaaagacagcttcttttactgttagacttgaacttggatggatgttctaccagaatttctggcagccacccaaccactatataccatcctaagaagaaagctatcagacccaaagtttaagctgtaagatcgagagttaccaagttctgatatccatgttgaacaccttgttcaagccacacctgaagacaaattctcttgttgtcaattccatgtcccaattaattacctcattttgcttaagccaatttgattagcttttctgtcacttgcaatcaaagattactgatgccactttggctaggaaaaaaataatgtaacatgtttaactcatcttcctgaacttgaatcagaataattcaaactacagggtagtgcatctctcttcatcatccttcccttttcttaccattcttctctttttcttcatcattcttccctttttcctgggacacccacctctcttcacaaatctcacttttccctgcatgagctcttcatctttcctcattgttttttgtttttctctaatatgtgctgagattggtttcttctcaaagactctgacagccacaacagccaagaccaagacttaagacatgacaagttgccaccaataataatcgcttatcattaagctgttccagcaaagagaaaaagcaaaccagtcccgttcattaagttttcgtctccggctatcatacatagaggagctgctgctgaactgaaggaagcagctttatttctgcaataaaaaggagtgtcttgggctttcccataacacttgctaggggcaggccctggtggtaaacattatcgtcgaaatgtccatttcaaaaatatcccagtgttctcaaagaaatgtctccaaacagctctgaatgctcaagttccagaagaaattgcttcttctccctttgggagtctgtatgttcctgttatcaaaggcacagacactggtaccaaatagagggttcaaatttcagctctttctcttactggtgtctgggccttggacaaaatccttactagctctgaggctccattttctcatttttttttttaaatggagggaattttattccctaccttaaagaggttgttgtgattgggataatgcatgtattactctgagcacataccgagagctccattaatgagagctgtgattatggtggctgttgtaatcaagaaagaatcaaccacaatgacagcaacaaaacccaaaacactacaacccacaaacacagcactaatgcaaatacaaacagctcccctgtggcttttttccacgtcttctaaatgacacaactttgcagcaccatggcaaaggagctcttatcgcgtgccaagcactgaggtgaaagcaggttgacaacccatcccaatgttaaacctgaatgttccgctttgcaggaaccctttcagtcctggacaaatcaggacaatcagtcgatcacacagagatcttcaagtgcatttatttaatcctcacactaatgtttcagggaatatttctattcccattctacagttaaggaagttggggcttagagagaggcagttctcaaactccaatgagcataagaatcaccttggatcttgttaaaacacagcgggtgggggctggggcattgcaagcaagctcccgagtggcatcagttgctgctagtccatggaccaagctttcagtagcaaagttctagaggtcaagtcacatggcatgcccaatatcatgctgcaagcatctctcagagtgatggttctgacccaggggtcctggtgccaggtgacctctgtccatcccagggaggactaggcaatgacataagacagtgtctgatgtctaacattctcaccaccgtgtgtttccttcaggtatatcacaggtatgtcatgcctgtcagtccccatcgtcttatccagcaaaacactttcagttatgagtcagaacatactgcatgggagtaaaggaagaggggccaccctggggtgaaccgcctcactcctgggagagaactgaagccatccaggaacgagaagagcacagagagagaaggaagcaccggtcagtcctatggtgcccatggccatctgccaagcaaagaaaatgaccccagggtatgcatagccacccttctctgcatgccagcgctgcagctcacaaatgtacgcaagtggctgggtctccctgagcctccatttttttcatctataaaatggacctggcagttttctaattacctggaggggagctggggtatctgtaacagggtaatgagcaagagctccatgaactgaaaggtaggggactaatgtgggagctcactgaggaaataggaaacagctgccgcctcctctctcccctccacctccacggtgctcccagaacacactgtccaggtctctattgtcaatcgtcaccaggtattttaggtgtctatttaaatagctgtctccatgcaaccagattaatgctaattcatctgtacagtaatagcacacagcccagctcccagtacatggggagctgagaacacattcagtgaaggtataagtaagcaggtgaatggatggacagacgaatgcatggatggatggacggacggatgaatagattggatggatagatggatgaatggatggacagatggatggatggatggtcaaataggacaaatggatggacaggtggatggatgggtgggtggatgaatggatgggtgggcagatgaatggacagatgagtggatagatggatagggtagatggatggatgacggaagagaaaaatgaacagatggatggatggttgggaggatgaatgaatgaatgaatggatggatgaatggatagacggacagatggatggatgggtagacgggtgggtggatggatgaatggagagatgggataaacagatggacagatggatggacagatggatggatggacagataaatggatgggtggttggatggatggacggacagataaatggatggatgggtgggtgggtggatggatggatggatggacagatgaacagatggacggatgggtggatgtgacatgagttgtgggtataagagattgaagaaataaacgaacatccagtgagaaaggcagtggctgagttagtagcacagtgatgggttagagagggcagggtataagtgagagctggatgaacagggggtgtgaaatgagggggctcagaggtagaactgagtgtctgcagtgtgagaatccattgctacccaaactctcacaatctgaaggcaggaaagtaataaacaattctgaggagggttgggctggcattcttcactgtctgaacccttgttacttgctctctaggattcaggaaccaaacagattcaggcaaagtggattccttctctatcaaaacccaggaaaggaattgattccaaaaagagcccatgtccttgctgctgtcagagatgactgagggctcttgtgagcacagggacagactgtttccctcccctaatctctagcccactcccaagcccctttatgtgttctcctctcccagctacatatcctcacctaaagcttttcctaggtatctttagtcttgcaggtggtgtgagaggatccctagggagcccttggacctcatggttacttgaggccctagccaaggtagaaaaaagaaactaccaagggtctaggagggaggaggtcaccacccatcagatgtgggtacctggagacccacatcttattgctccttctaggtatccaaagctcccaggaagctttgcaagcatcattttcacccctctcactttgcagagccctacaacttgaataggctacaatgacagccttctctaatgaggctactaagcagatagcaaacaggacagctataattgctttgcaggagcagagtcccagccaaatcatgggagatggcttagtgcagtggaaggcgcaaggattttggaataagacacatctaggtccaaacctcagttcttccacaggctacccgtgttgccttgagaaactggctcaaccccttaagcctccgtgtcctaggctgtaaaacaggaaaagcaatttccaccaacttcatagatcagatgagctcatgtacagtagctgtttactgattatttattgcattccgatcatttcttccacattatctcattcagtctttaacgaaaccccatgaagaaggtagtattaatgtctaatgtcaaaactaattaatttaaattttactggattccaaaacccttgctcttcaccactgacaacgtgcacctccctccttatcggtgcttaacctgtgagctccctttcctttacctggtcattctcccatatattcagataccatctgaagatcaacccttccccagcacagtgcttcctccatcaccagcttcttcctctggaagcaatgcatccacagcagaagaatgcaccctgaactaatgccaggagatttagcaacctaatctgcactgttttcctggagcataatattctgctcgcaaatcactccccccactgaagctaacacaatacagagcatcctttaacttatgtaaataagcatcttatgggcatccgatttattcacctctcattgctttggagaccagcagaccaaatacagaatatcatctgcccctttaacagagcaacgctaaattctcatgggtgcatttgtgtttgtgtttgtgtatgtgcgcacaggcgtgcatgtcaaaaagctaatatctgtttgttctcttcagcaagtactaagctgggcagcctgtccaagacccacttgcagctcaaaagaagaggatgaactaatatgaccagagctcaccattacaattaaactctgagcacaaatggaattaggagcataaacaaggggtggaaaagggagagattttaacagaaaaaaatgatggtttgtttttttctccgaagtgacatagaaaaagaaattgaatgtcagcctctgaaaagtgtccaaattactatttgaaaggagaaaaacacaatcaaataaggtccatttgtgttcatgctgagccccagggcttcctggctcccatcacactcagagctggttgcaggcgagagcccaagtcagcccatgtgttcttcaacctcaggtaagtttgtcttctccagtgttgatgaacacagaaggcactccttcctcagggctcagaggacagagaagccctgacactcactgcccagtgacctcccagcccccaacgataccgctcacccttgggtatttcatatttgctgcaaactttgtagcaaccacgagaaataaatagaaggctctccttcacactttgtacctgagaaaattaaggctggaagtgtggagggttcactggcctccaagcctcacccagaaagaaagtcatggagccacagagctcaacccaccctcagcatgctccagtagtgagagttgtggccaaagaaagctcagggcaccaagggaatgcagaggaaggggacccacccaacccagcaagagagggtgaaagggttcccagtgacccctgaggtccttgtagatggagggcaacttggcacaggctggaaaggtctggagacagagtacagagaggacagtgtacaaagacagtgtgcagagacacacagaatgaagaacatggcacccactgggaatgtgagcagcttagtgctgaagaaacacatgcaaaaaaaaagaaaaaagagccagagaagtgtgtggctaggggaagaggcagggcccgagggtaggtccatgcctctctggctcacaatgagaaatacctttgaatctggttccatagttatctgtcacctttacgttccatataactcatatgatttacttacaatgcttattattaatattttctgtctgttcaatgtcctatttgatagaatataagctccatgaagtcaggtatattctgtttgttcattgatcccaagtacacgtgacagagcctgccacagagaggaactcaatgcttatatctgtgggattggattaaagacattcaaataattattgaatgaaagagagaaagtcaggcaacaagaaagtgagagaaaaagggaaaaaggaagaaaaagagggaggaagaaagagcatggaaaggaggaaggatggagagacacagacagggagtgaaaaaaagagacaaggagttaatgctttctggggttgacgagaagaatccatgaaagaattttttagcagcggtgtgacatgagcaagtttttatcttcgggaaggaccacttgagcttgagtatgaggaagggcttggaggagggaatgaatgaaggcagaaaagcaggcccagagaaatctcactaaagcaactccagaaaagagagaaagatctgaactaggattgctgcaatacagatacacaaaagagaggttcaagagatgtttaggaggtacattcaactggtcttggcaactcatggatcggattggcagggagattggggagtgaaagaggattgccaagtgaatggtgatgtcacttacaaaagtggagaacaggttagggaccctgctttcttcctcacaattgtagctccagcacctagccttgtacctgacatacagtagccactctgtaaatgttttttgaatgaatgagtgagcaagggtggaagtgagtataggtagggggacagagaaatgcatatggaattcaggtttaggttagctgcttttgaaacctccctgcagggagtccaccaagaaggtggataggcaggtctgaagatgagaaaggggtcagggctgaggcttgagatttagaagttgtctatctgctgggggcggtagttgttgacagctgtgcatggcatcccctaacaaaagaaggagagtgtgtgtggaaaagaggcagagaaggaatgtaggagaggtacgaggagaaagccggggaatgcgataacttagaagccacgggagtagagagcttgaagacgaaggcaggggtgaaaggtgtctagtgtccaggaagacaaaggctgaaaggtactgctgtgtggtgcagtgagatgttcacctgggactttaaggcaagtggagtaggtagaagcacaacctcagagtggtccagaggagtgaaggaggcagaagtagtaaaggggacagtggaggacgttccaacactttccaactgccccatgcttcttctcaaacacaacagtattttagaggtatagagaagaatttctctgaatactgggattcaaactggggtcagggggctcctcctcctgctttcttttttccccattccccaatgtcctctaagtcaatccttctgtcctagacagagaaacttgtgccagaaaacacaggatatcctaaaataactccctacatgctaaaggaaaacgaagtgaacatttttcctttttaattccaaaatcatgcttgcgatataccttcaatgttgaagaacaagattccttagtttttcaccccggacatcaccttttccttacagagaaaacgtaaaatctaagtgtgtcttgttccccagagaacaaaaaggaagtgaaaattagatgtgcacatggtcggcagattgagatagacagattcctagacactctctggagttaagacggctgctctttccagctcacacacattgcatcatcttgctgttgatgtctcctcaaggatttgttccaacactctgatttgtaaaggacccagaacagagcttattaaaaactcaagacactatatctgatgggggagcatcaaggggccattaaacactcacctcattaatagcctgcagaatgagtccttttctaaagctcacacaagatggtgattagacagtcctggcatacaaacccatctctccatttttcaatcccttgccgagcaaaattttcaggccacaaattagaggtacccctggcttaaaacaaaacaaaacaaaaaggttgggattttaatgagccttctgcctctaaataaatctctctacccggcactcaagtcctctccagacttaaatgaaatgcatcgacaaagcaagtcatgcagtgggatgaatccagaattcaatatgagtcaaagtcctcctttctccaggccagcgtcctttatgttcattatgttgagtggtaagtttgtaccaagtggcgttaggcttactccacagttattatgcacatagtgactgtgatgatgtggtttccatcacctgggatcagactgtacttattctacagactgtctgaagttggggatgagtttggtgtcatccccatgggcagtcaataaatccttgcagccatttgcctgagtcaaggcgagggtttcactctctcaacagcctgagcttaccactactgcagtgctgaccattcagtgtcaaatgtcactgaggacaaataccacaaatcaccacatggcctgtggataccaatgggatatgtagtcttgtcacagatcacagcctccccaccttgctttctcctctctggatgcaatgacctctcggccaccttgtgtccaccacagagactttgcttgtcttgttccaggttccttgaactgttcttaccttctctgtccaactcctattcttccttcattcatttctagatcatcatttcctaagggatgtcttccataccctcacggattaggcaaatttccgctcttccatgctctttcttgtattaggttagtgcaaaagtaaattactgttactgcccctacctttaatggcaaaaacagcaattacttttgcaccaacctaatattttcatagtacttaatgtggctgttaatcaacattgatttatagactgctttcatgaatgtatgtgtccaccatttaaacaaattgtccagaaaggcaggggctatgtgtgctgttttattttgtcttactaatcactatatctccagcactgtagaagcctaattccatttttggttttgttttggtttactagtttactggcttgttttgaatgaggttaggcagcttgcctaagtgcatcaaggcgaatgagctccctgtgtcacacagcatcgagtaagtcatttctttcaaactctctctcaccgccagcttcaacaaaccaggaaacccatcaggctgtatcacctttgggcagaaatccccaggggcttgggcatcacgctgacaaagtctctgccaggtgttaggtgctggttcctatcattggttccatcaccccttaaagcggcttgcaacatccttgtaaagttctgttgttcggactcatgatcaagacacaaaacaattctcaggggcttgaatcagcccctcctagctgctactgggtgaacactgtgatttgtgacaggtaatttaaatgcaacaagtagactttcttcaaatgtagctgccactgaagtgagatgtttggaaagaatccactgtcctgtgggctttcttgtgttttctgtttttgtttctgttattttcatgttttaacttaaaaaattttaaacctctacctataagccacataatacccatacttaaaaagcaaaggtgaataaaaattcagattctcaggggatctatgcaagtcctggtttatcacgtatgagccgtgtgtctcaggaaactcacttcatttcactgatctttagagcttcagtctcttcacaggaatgacaaatagtatgaatcttaccaacttctagaactgcacagtgagccagatgtcaattatcacttaactgtgtctttaattaattcattcatttaacctattatttattcatctctggaccaggtacagtgctgaaggctgagaatccagtagtgaacaaaaacagccatgaaacctgcgctcaaagagcttatgatccagatggaaaagacaaatattaattaaacaactacacacgtgtaaaattgccattgaaattcacattttgtaagaaaagcttatggtgcattaagaatgcacaatgggggaaacagaacaatttagatggttgaagacttctccaaacaggagatgctggagtaggggttatctaggcaaagaggagaggacagaatgcctcttgcaaagaaggtgcttcatatgcaaaggtacccagataggaggcaagtgtgagggtctttaagatagccattggggtgagggtgaaagagactggttctctgctaataaaatgtatttgtattcctttgtacctaaagaagaggctattaccttcctctgacctctcagttgcccaagaatcttttcacagtttctatctaatccctttcaataattccctggctgctaatcagagaaaaggtgttaattcccttattagcatacctctgcctctctgtgatcacaaaatgctcctaacttcctccaccctgggaatgcccttggctttcactctggccctgtgtgctatctccctagggcttgttctcagccagggggaccagcctggcactcatctggtgccagcccctaattttactcagggaagattatttaagggagctgcccatgttcaggacacacacagtggatataggattgagctccaaacacagggctgctctcactgtgggacacagccactccctatctcatggaccacccaaggaagaacaagctctttcacttctgcgagcactcttcagtatttgggtcctgatactgtggtacctttaataaacttttttcatgccttcccatgtgaaaccccaattcactttgaaagacattaccagtaacaatatcacaatccacagttgttctctgcatgcactgggtggccagagtagtggaaataaagcaaatataaaacctaagaggcagcttctaataggaagggagattacccaaatgatgtcatcgcatcataattagcaatagggccagaattaccaaccacagcaaagcacgtcaaaatggggctatctcaactcttccttaattgggaaatttaacaaccgaaagatgcccctcgatgactctgaagggcttggtttctcgcatttcctggacctctttgaacctcacctgagaactcttctatagacttgggcaggtgaacatcacctgggcctctgcctgttggttttcagcagggttttcacattggttgcccccatgagcaacacttggccactgatatgaagggcttccccaaagaacacggttggcttgttttccatgttgattgtgcatgcttctctagtctttcctctcagttataccaggaaagagagatagtgataaactgctttagaatcacagctctgctatctccaagctgggtgactatgaggaagttgcttagcttctctgtgcctgccttcttcctccataaatgaagataactataacttctgcataagcgactgtgaggattaaaattggcaattgatgtaaaagcatctggcatgcaattaacttccaatacatttagttgttatcataattgccattaataacatccagcctgacctgaacttactactaaatccatcctccttgaatgctgacttgccacaaagccatggctccctcttgctgatgtgggcaatgttggtcttctgagatcatctttcttggcaaaccagaccgtgaattgccaaatttactactcctcatgcccatcaatgaccacacagacacatgcacacacacacacaggttcaaccccacttccatatctttagcaatggtctcctggggctctgttcccacggattttatctggcacagtatgtctgaggtgtgacccagaaatccgtatttttaagtagattctgaagcaaatagtctgcaaattggtactaggacagaccccatgggatggaagcactttgccaaagtgaactatcaggaattacagagagctggggaaagaatgcttgctgtgtattaggtttcagttgcatatattcgtttgcataccagattgcaagcagagggcagaaattagaacctgaatagcttcataccttacctccacctgtctccaagccacatatagtatgtgctaaataaacactaaagcataaactgccttaacagactagaaaatcgatacaagcatgggcttgttcactgatacatcccttgtgctggctgtacagaaggtgccagtgaatatttgttagataaatgaattaatgaataaatacagaggagttggtagggaaaaggcacaaaatgagcagaattggtgctaatttatgttgaatcagacaaatgttcagcttatgccccaaatttttacaaccatctcccttttaagtcactgaacaactgctaggagcctctgagccatgctaccccagaataccccagaatactcattcctattcaaatatttggttttcagtgttacaaggacaagtattcatttggaccagagaaataggctggatttgcactcatctgtcacagtgccctgaaatcagcctcaaatgattcacagccctcttgaaaacatctccaatctcctaagagataaaaagcctcactcattttcccacccctgacccaccaaccagcttccatccctaaacctagagcgaaattatgatgttctgtctcctcctcctatttctattcctcatgccctgcatgtctccccataggagctcataataggcttgtaggttccacctgattctgaaaatcaagttatggcaccgaggttttggaatcacttcaatctatttgcagagtgagcctggttagtatttaaatatgccacccaagctaccgatgtgcaacgtatcaactcttcacctgggatgatttattccaggagtcgccgttctgacttagtacacaggctttccactgtgctaaagcaaggagcccaaagaactagagggcttgccaatggttttcttgtggttttattcgtgtactaattaaaaacattggccaggcatggcggctcacgcctgtaatcctaacactttgggaggctgaggtgggtatatcacctgaggtcaggagttcgagaccagcctggccaacatggtgaaaccccatctctactaaaaatacaaaaactacctgggcgtggtggcgcatgcctgtgatcccagctactcagaggatgaagcaacagaatcgcttgaacccgggaggcagaggttgcattgagccaaaatcgggccactgcactccagcctcggtgacagagcgagatttcatctcaaaaaaacaaacaaaaaccatagcacataccagcaaacctagaaactcactgaaaccacataattgagcaatattaaaggcagagatgatgtggcttccaggttgacacccaactatctggcccaggtaacagatagtagaacctagtagtaaaaaaggaaaaaaatgagctttgcatataggaggggctcaatcaacaatgtcccatagtaggtaattcataaatatcagttgaataaatactgaatgaactagattgcagacacagagtttataacaacctaagtagagattacatgaaaaagttggatataattttgcatgtatacttttatcataaccttattaaataaacagataaaaaactatacacagaaaataatgcaaaaagataatacaccccaaaatactaagagcgactgttcttgggttgtagcatatggatgcctttacattttcttgcttctgcttttctgtatttttcaaattttccataattagcctgtttcttttataaatgaaaaattaactggaaaacgaggcagcctaggtaggtagggagagcatatgctgtgaagtcaaccagactatcttttattaattgtatcacttgttcctaacgtgtaatttttcttttttatacactttatttttatttatgtatttatttcagacaaggtctggctctgttacccaggctggagtgcaatggcatgatctcagctccctgcaacctctgcctcctgggctcaaaccatcctcccacctcaacctcccaagtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttgtcatttacgtgcaatttaatggatgtaaaatactcagcactatagtacttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatcctaacgaatgaaccacaaaagcatcatgctgaagcaaaagaagccagccacaaaacaaaggcatgctatacaagcccatttataacagaacagaatggaaattttataaaagttcaagaacaagcaaaactaatctatgatgattgaattcagaataatggttatcttggggttggtgagaagggagcaaataagaacttcatagggaactagaaatgttctatatctttgcaatgtatctatgtaataaaactgcacttgcacctcttaaatttaaacaaaatttttgagatttttcgtgaaaacggccatactgcccaaggtaatttatagattcaatgccatccccatcaagctaccaatgactttcttcacagaattggaaaaaactactttaaagttcatatggaaccaaaaaagagcccacaatgccaagttaatcctcagccaaaagaacaaagctggaggcatcacgctacctgacttcaaactatgctacaaggctacagtaaccaaaacagcatggtactggtaccaaaacagaacagaacagagccctcagaaataataccacatatctacaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggatctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgggactgtaaactagttcaaccattgtggaagtcggtgtggaaatcggtagattgctcagggatctagaactagaaataccatttgacccagccatcccattactgagtatatacccaaaggattataaatcatgctgccataaagacacatacacacgtatgtttactgcggcactattcacaatagcaaagacttgaaaccaacccaaatgtccaacaatgatagactggtttaagaaaatgtggcacatatacaccatggaatactatgcagccataaaataggatgagttcatgtcctttgtaggggcatggatgaagctggaaaccatcactctcagcaaactatcgcaaggacaaaaaaccaaacaccacatgttctcactcataggtgggaactgaacaatgagaacacacggacacaggaaagggaacatcacacatcggggactgttgtggggtggggggcggggagggatagcattaggagatatacctaatgctaaatgacgagttaatgggtgcagcacaccaacatggcacatgtatacatatgtaacaaacctgcacattgtgcacatgtaccctaaaacttaaagtataataaaaaaaaattttactctaagttccaggatacatgtgtagcatgtgcaggtttgttacataggtatacacgtgccatggtggttggctgcccctatcaatctgtcatctatattttaagccccgcatgcattaggtatttgtcctaatgctctccctcctcttgccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagtagtgaaacatgagtcactgttaagttctcacgatgaaattctcactattagttcagcactattaagtgactcatgttcgacacttcagtggtagattctgtgttcagcaggtcccacattttgaaatttggggtgaattcttcctgcgactctgtggtaataaagaatatgaattatgcttacaattgcaaagatatggaacaaacctaagtgcccatcagccaatgagtggatcaagaaaatgtggtagatatacaccacggaatactattcagtcataaaaaggaacaaaatgatgtcttgcagcaacttagatgaagctggaagccattattcgaagcgaagtaactcgggaatggaaaaccaaatatcgttatgttctcacttataagtgggagctaagctatgacgatgcaaaggtataagaatgatacaatgggccgggcacagtgactcacgcctgtaatccccgcactttgggaggccaaggcgggtggatcacttgaggtcaggagtttgagaccagcctggctaacgtggcgaaacccgtgtctactaaaaatacaaaaattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactttggggacttaggggtagggaaagtttgggagggggtgagggataaaagactacaatagttagtagtcttaggtgatgggtgcaccaaaatctcagaaatgaccactaaacaacttatccctgtaaccaaaagcacctgtaccccaaaaactattgaaatagaaattaaaaaaattttaaaacagtatgaattattaatgcattaggaggcaaagacagtgaaatgtcagaaagaaagacacttatgactgcggttggaattcatacagtgtttcattatttccaaaggtagtccccatctattatctcacgtaaacctccagacaacccagtgggtaggcgttattattgcaacgtgattcttactcccattttgcaggaaaaaaggaggaggctgaaagaggttgaaaatagatacaagttaatctccccgacactccccctatccattcaatgacaatctctctaggctttgtattgcttccttccttcttctctcccctgcatctatcatttctttgcctctattgacttgtatgtatgtatgtatgtatgtatgtatgtatgtatgtatgtatacatgtacgtatgtatgtatttagagatggagtttcgctcttattacccaggctggagtgcaatggtacgatcttggctcactgcaacttccgcctcccgggttcaagcaattctcctgcctcagcctcccaagtagctggaattacaggcatgcgccaccacacctggctaattttgtatttttagtagatttggggtttcaccatgttggccaggatggtctcgaactcctgacctcaggtgatccacccacctcggcctcccaaagtgctggaattacaggcatgagccaccatacctggtcgtatttatttttttgacagagttttgctcttgttacccaggcgggagtgcggtggcgtgatctcggctcactgcaacccctgactcccgggttcaagagagtctcctgcttcagtctcccaagtagctgggattataggtgggcaccaccacacccagctaattttgtaattttagtagagatggggtttctccatgttggtcaggctggtctcaaactcccaacctcaggtgatccgcccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaattcagagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactcgccacttaatgagttagtgttccccaaggctctgtgttgcatccattgttcctcactgggtacatcatttacttggacattttatccatccttcatggttttaaatatatgccaatgccttccaaatccagatcattccactgggctttgatatttaaagaactggatgttcatggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgctaaacatcctacaatgcacaggaaagctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacactacagttcaagaatcacactctaggtagagccaaccttgacgtcaaagaaatctcgagttcttgttctgcaccaagcattgggatccctaatacagaaaaaagcagctcaaattcaatgtttgagtaagcacttgacttcagccttcaggatacaacctgctaggcctccaggtgaataatttaacttgttttctctttattagcactattccagaaaaaaattgacctgtaaggttcatagtccaaagcaacaagtctttaatgtacaatccttttcttagccctggagcttggagattatttcttcaagtttaaagctaggaaatagagcagtgttttggtgcattgcccactagagagactggagtagagaccaatgcaggaaaatcctgaaaccttttcatcttattaagctcagtttatattttaaaacatatgaaagaaagtgcttttgagatatggagataaagatacgatagatctgctaaggaaaagaggccttgaggattgtttagattcacttggctgctggagggccctagaaagaagtaaattagaggggaaataaatctggaatcgagttcttgctctgccttaactgactgtgaatttaaaaaaaatcattttggttcaagaaatatgtattaaggatctctgatgagctagacacaaagttaggtactgaagataaaataaataaagcaggcagagtcccctaccttaagaaaattacaggctggtaaactctcaacaggagaaatattggatatatcaaatatagttccttcccctgagaaacgcagactggttggtgagacagacaaatagattttatgatttcagaacaatgtagtaaatgttaaagtattacagaatgctatggaataatggagagatgagaggcttattcaccctgggaaataaaggaagcctttctggagaagacaaagagttgtgtagatagtcatttgagaggcaagactggggggaaggggagaggctagaaggctatttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaatagaaaagcctaattttcagtaaaacagaagcttccacttcttccctgatataacaatttcccttgggtatgtcaactcaaaactcaaccaccatgctttgtgaaatccaagccacataaaaaggttacattaggcagtgagctacgcccccaagccaatagccagctccatccacttagccatgtcatgagccatctcatacatttcagcccaactgtgctctcagggaactgtagcctcagctgttattacatgcagcagaaaaaccacctagtagagcccagtcaacccacagaactgtgactgacaataaaatgattcttgtttctagctcctgtatcttgtagcaagaatatataagaatgtaaaactgccaatgtcgggtaagaaaatgagatggctgaagatgatgacatgtcagtctaactttaccataaaaattatctgatctagtttatctgaaaaatagttccagcagtgtagaagtttaagaaaacagcagaagatagccagagttctgcttctggtatggtaggaaatctcttaacagattccctcccacacccaaacaggtaaaaaattaaagctagaaggaaaaaaaaaatatacctgaaggctctgtagagtaaaaatagccagtagatttcacagggacattgaaacatggaagaagggctcatcatagagttctacatttttgccacctaggtctgacagcatgctgctgtcccaaaatggcaccgggtggctcaacatctagtggaagagccaacctctttctggcctgaggaggtggaagttagagacctggaagtccacggccagcagaatataaaaaccccagaaagaggagacttagagaagggaattcttggcatgtatatgtaaactctgcccaagcctctggccagtccttgaacaaagggtgagtagacaaggctcaaagtagtttgcatttaaacccaacaggactgagaactaagcctccacctgagagacagatatggaaatgtaagtataaccaggttagttacctgctaagacacaaatatgaatactctttaaggaaatataacccacaatatagcattcacaaagtgctagtacaattcaaaattactttacatataagaagtagggaaatctgacccattctcaagcaaaaaagacttactttacatataagaaatagggaaatctgacccattctcaaggaaagaagacaatcaacagaggccaatcccaatatgatccaggtgttaaagcagctattctaacaatacacttaatgaggtaaaggaaaatatgctcatcacaaagaaaaaggtaggaagcctcagaagaggaaaataaaaaaaagaacatttagaaatgaaaaacaaaatatctgaaataaagaatttactggatagaactaacatgagaatgaagatgacataggcaggagtcagagagcttgaagatagatcaatagaaatgacttaagcagaggggcttttataaattgacagagtgagatctaacatacatgtgattaaagtgtaaccacccaagatcaccttgccactgtctagacagagccgatttatcaagacaggggaattgcaatagagaaagagtaattcacacacagccagctgtgcaggagaccagagttttattatgactcaaaatcagtttccccaagaatacagggatcagagtttttaaggataatttggtgggtagagggccagtgattcaggagttctgattggctgtctggagatgaaatcacagggcgttaaaattgtcctcctgctgtgagtccgttcctgggtgggggccacaaggccagatgagccagtttatcaatctgggtggtgctaactgatccatcagatgaagggtctgcaaaatatctcaagtaccgatcttaggttttacaatagtgatgttatccccaggagcaatttggggaggtttagagtcttgcagccttcaactgcatgactcctaaaccataatttctcatcctctggctttaggcaatccccaggcaggaagggtgtttgttttgggaaagggctaatatctctttgtttcaaagttaaactataaactaagtttctctgaaggttattttggcctacacctccgcccaggaaaaacaaggacaacttggaggttagaagcaagatgaagtcacttaagtcagatctctttcactgccatgatttctcagttataatttttgcaaaggtggtttcaaaagttcctacaagaaagagaatggagaaggggaaaaaatattgaagaataatggccaaaaagaaatttggtgaaagacataaacttacaaattcaagaaactcaaagaaccccaaataggacaaatgtggagaaaaccatgctaggcacatcacagtcaaactgatgaaaatcaaaagaaagaaaatctcaaaattagcaagagaaaaatagcacattatatatagagaacaatgattcaaatttttcacagacttaagattagaaactacagagtccagaagacagtggaataatgtctttataagtgctggggggaaaaaaaacaaattctataattagtgaaaatgcccttcaagaatgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaagagcattagaagcataaatatctggataagcataaaagactcttcttttaattaaaaaaatacatatgcatgtgactatttaaagcacaaatccttacattgcctcttagggtattaatgtacagatgcaatgcatataacactatagcatacaggatggtgagggtggaagaagagagacaggccctctcacattgttttatacggttttatactcagaaaaagaaagagaagcgaaactaaaggcagttagcctggtgcctaggaaccagacccaaaaccaaggaaccagacccgaaatcaggcctgggcctgcctgacctaagcctggtagttaaagatcgacccctgacctaaccggttatgttatctatagattccagacattgtatggaaaagcactgtgaaaatccctgtcctgttctgtttcgttctgattaccggtgcatgcagcccccagtcacatactccctgcttgctcaatcgatcacgaccctctcacgtggacccccttagagttgtgagcccttaaaagggacaggaattgctcagtcggggagctcaactcttgagacaggagtcttgccgatgctcgcggccgaataaacctcttccttctttaactccgtgtctgaggagttttgtctgcggctcgtcctgctacaaggggaatgagtaggccctatactgaaaagtttctacattgtatgtgaagcaatgcaataccaaccctaagtagcctgtgaaaagctaaagatgtttcatgtgatccctagagcaatcactttaaaaatgcaaatagagataatttcacttcttcctttccaatttggaagccttttatttctttttctggcctaattgctctggctaggacttccagtactatgctgaatagaagtggtgagattgaacatctttgtcttgttcctgatcatagaggaaaagctctcaattttcaccactgagtatggtgtttgttgtgggcttgttgtatttgacctttattggatatacttctatcatgaaaacactcagaaaactggttatagaaggaaatagtttaaattttataggaattaaagtattaaaatttttaaataattttctgcatctattaagataattctgcatctattgagatgagaggtatagattaaaagccaataaataagttaaaacaaagtgtgtaaatactctaaaaatccataaaaaggcagatataatgggcaaaatggatcccccaaagatgtccacacctttaaccctggaacctctgaatgtgttatgttacatgaaaaaagtgattatggacctaaaaacggagagattatcctggtttattccatggatcctactcacaagtcccctgaaaaacagagaactttctccagctggagtcagagaagtagcagagaagaagtcagagagactcaaagtgtcagaagatcttcattcaccattgctggaggagctacatggaaagcatgagaaagaagtctctaggagcaaagaccagcctgccatccacagactgcaaataaatgggaacctcagttccacaactcttcggtttgtgaatcattcgtcacagcagcaacagaaaactaacagagcaggaaagggagaagagagacatgaaaaacagaggggaaatacagaaacaacaataaacatgccaaacccaaacacatcgataactgcattaaatgactgtggactaaaagttgaagactctcagaatggatcaaacaaaaacaagaccaactattctctacctacaagagatgtactttcaatgtaaagacgcagacagattcaaagtaaattaatggaaaaagatacaacacacaaccagaaaatgttagaagaatggaccatctttattagcatcagataaaacagacttcaagacagtattcccggaggggcatttcataatgagaaaagggtcaattcatcagaaagatataataaccataaatgtgtatgaacttaataacagaacccccaaaaatacagaatggaactaaaaggaaaaatagacaactccacaatcacagtttctcttcaacttccatcacagatatttcccattatttattattagtctataaaccaactttttaaaatgtaattaagctattctaaaggaaattttatagcttacataaatggggagcctcgtgtcacttacataaataatcaccttgaacataaagcaaaccatatcattaaatcctggccagacaccatggcatgactactatgtgagtctgtgttctttaactggggctgtgtaccacctaaagccatctcatttacctgaggtgatatgcagccccatattctgggaaacacttatgtaacctaactctctcacatgtccaaaggaggacaggacactaactggtctcctgtaaccaaacaagttgctgccagatcccggtgttctgatcctttgttgaacgttccttcctctgttctgtgagtcttttattagcattaagagtggaacccaagcctcctctttaaagttggcgtttgaaacccaacagaaaactgcaagctccaggaccctgaaccaactgagactcagaagtgctggtggcattcagcatccaagaacacttagagccaagtttgtgctgtctttttaacacgactaataccatcagtggaattaatagaaaaatgaaagccggcactctaattccagtaatgaaatcacaggcgcacagctcccacctttaggagcctcacaaatgatgcatgtcctctgaagccattcagctggcgtcacttgtagatatatccctccgagggaagccactatccatccggtggccagcctgacaccacatcgcgtgacaaatgacatctgagaaccaagtcgtaccaggcaaaggctgccacatgagtggaatacaaaatagttttctgcatgtgttcagttcactgctgtaaataagattcactggagacctgaaacaggagggcccaaaataattttggttctgattccgacaacaaagaaagagttgactctccaccttctctaactgatcatagtgattaatctctcaccagccagtttattacatagtcctgctcaatctaaagctggcatgcaagacaccattttcaaaaattaaacaagccaggtgtggggacacatgcctgtaatcccagctacttgggaggctgaggcaggaggatcgcttgagcccaggaatccaaggctgcagtgagccatgactgtgtcactgcactccagcctgggcaacagagcaatactcttggagcaagggaggaaggggggagggagggaggactgaccggagtttgaatcctgggtttatcatttgctaattgagtgattttaggaagttatttaagccttgaagtctccatttcctaatctgtaaaactgaaaaaatagtattacctcaccctaaatgagataattataattaaagttaatttcattgcatgccatctgccagatactatgttaagccctttatgtgtagaaatgaaaggagagttctgtgcgcacgctaggtgctctgtatacagcgtaccacccactccaaagctgagagtggaaggcagagctcaagcaatcattaaccacagcacacgttcaggcagctttgccactaaattttaaccagtacatatataaaagtgtcccactctcctcctcatatcccatatgcacacgtgcacacccatgtgtgcatgtactcacatgtgcacacacacacatacacacacacttcaattcggtcggcttttccttggggagtagactttggtgagtaaatacctctcttagctcaatctcagctccaagcaaattgaaaatctctactaattcacaaaaaaataaaaataaaaaaataaaactttttaattaggtcaaccctgcagcttaacaacgaagatgaagaaaaagatcttgggcaagaacaagacagctgtggtttgagaagaaggcactagacttggagttagaacttggatgctggctgtgccatatattcactggatgattttggacacattcttcacctttctgagccttttcttccatgcaaaatgaggcagttggatgttatacttctaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaatgcagttacagggacctggctcagcctcttcctatctgtgtgaacttgggcaagtcttttcaccttgcttaccctcagtttgctcatttcgagaaaggtgataattcccagccttgctggtttattgtgatgattaacatgagtatggaaggtggttagtactttgtctgctccttagtccttctcctcctcctccctatcctcttcctcctctcattcctctccttccccttcctcctctacttcctcctctttctcctcctccctttcctccccatcctcctcttactcctccttaatgaagcaagatcttccctctgtaagaacattacatttcttccactccatgacctggctcaagttcactatgaaaatgatcactgccagtaggaaaattcctccagaaggatttttatcacatttccctttgaagaggagcaaggaatcaacaattggcatcccttggaagatgaaagcaagttcctctgtattcggaacggatgttcctctggaatcagagtaatctcttaatggaccctgatgacataacgtggcacgggcttctcgtctgaaatggcaggttactcagcaagacagagggagagaagcagatggatgtgacagtaaattctgctatgtacccacagacacttctaagacattaaaaagtagtgcccacatttccgactcccacaacgaaacctgtgaagaaatcctgacgttgatttcaggagcatgtgggatcttgcctctcttacaatgcgggtccctcactctggttatgccaagcacagcttaaactgacccctctggttgtgagaaagtaagccaagaggagactaagattctaacaggtttattttatctactcaaaaggaacactagatctggagtctggtgaagaagattcaagctctcattctgtgacttactagcaatgacacagagggttgcctcagttgccttatctgtgaaatctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaccacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatgtatatgtatgtatttatctaggacttatattctgtgtgtgtgtgtgtgtgtgtgtgtgtgtgtatgagataaaagtatatatacccaagatatttatattatattgaaaatgaaactatagactctggtgatattggaaaattcccctatataactagggaatagtccagacatggtagctcagtcctgtaattccagcattttgggaagccaaggcaggcagatcacttgatgccaggagttcaagaccagcctggccaacatggtgaaacccccatctctactaacaaaaaaaacagaaaaagaaaaattagctgggcatggtggtgcacgcctgcagtcacagctacttaggaggctgaggcacgagaattgcttgaacccaagaggcagaggttgcagtgagccgagatcacacgactgcactccagcctggacaacagagactgtctcaaaaaaaaaaaaagagagtgataccatctcataccagttagaatggcgatcattaaaaagtcaggaaacaacaggtgctggagaggatgtggagaaataggaacacttttacactgttggtgggactgtaaactagttcaaccattgtggaagtcggtgtggcaattcctcagggatctacaactagaaataccatttgacccagccatcccattactgggtatatacccaaaggattataaatcatgctgctataaagacacatgcacatgtatgtttactgcggtactattcacaatagcaaagacttggaaccaacccaaatgtccaacaatgatagactagattaagaaaatgtggcacatatacaccatggaatactatgcagccataaaacaggatgagttcatgtcctttgtagggacatggatgaaggctggaaaccatcattctcagcaaattatcacaaggacaaaaggccaaacaccacatgttctcactcataggtgggaactgaacaatgagaacacatggacacaggaaggggaacatcacacaccagggactgttgtggggtggggggaggggggagggacagcattaggagatacacctaatgctaaatgatgagttaatgggtgcagcacaccaacatggcacatgtacacatatgtaacaaacctgcacgttgtgcacatgtaccctaaaacttaaagtataataataaaaaataaaaataaaataaataaataaaatattatattaggaaaaaaaaaagagagagagagagagaatagtttcaccctgtaaagtccttagaggaggaaaaaaagcaggcctgggctaaaggtgctaaagaactacaagacaggaaatgcacaaattaccattagaataaaaactgaaaatgccatccatgctgtttgttgttcacttactgaccaggaggattccttctatgatctcaaggcagcactgccatgctgctcagcgcctccaatcatgtctcaaggtaattgggctggtagatgtttacctatctgcaaagcttagttatgatcccattaggtcatttccagaaaggttcacataaacttgggtcactttatattctttttaaacttgtcatcatgggaaatgtcaaacatagaaaacagaaaaaatagtataacaaacccccatgtatcctccactcaattttaactattttcaattcgtgactgatcttgttttgtccatattcttaccaatgttctccttccaatgcattattttgaagtgaactccagatatcatatcattcatctgtaaatatttcagtatacatctctaaaagtcaaggactcctttttacaaatatcatcacaataccatcatcacactcaaaatttaccttaatccttaatattatcaagtgtctggtctgtgttcatatttcgctgattgttctatatacttttagaaaaatcgtattcttttgacttagaatacacacaaggtctatatgattaatatggtatttatttatgtatttatttttgagacagtcttgctcttttgcccaggctggagtgcaggggtgtgatctctgctcactgcaacctctgactcctgtgctcaaatgattctcctacctcagcctcctcagtagctgggattacagacatgtgccaccatgcctagctaatttttgtatttttagtagagacgggggtttcgccatgttgtccaggcaggtctggaactcctggcctcaagtgatctgcccacctcagcctcccaaagtgctgggattacaggtgtgagccccgcagccagtgtaattaatatgactcttgagactctttttatttcattgcatttttggttttaaaaactgggtcttttgttgcagtttccaatagtctggattttgctgatgacatgcccatgatgtcatctaacaggcttatgccccctcccatatttgctggcagttcaggccagaggtagatgcagatctcacttattttgccaggaatacttcataagtgatgtgtgtactttctttaaaaaataaattttctggttgtcttttgtaacattagcaggcattgacaataattgcctggatccattagttcattaacgtttgcaatgtagggatattccaattctactattccttcttcatttattacccggaactacgccaaaaagagaaatcttcctttgtcagctatttggcctgaggaagaactgatacaagaagggcagaatacagtaaacgcatgcttcttcccccatgtatgttttcagaacaatgaattggttccctagcatcctccaagggttaccaattagttatcttttaaaatatcttattattacaaactcacggattttatgtatttcaatgccctgcaattagtatcttcattgatgcccaagctgttccatctttggccagttgatttcagattggcttctgagtccctttgacctgtagtctttggtaactgctttgctcattgcagtgacaagacactctaggaaggtttatcttgttcatttccaccctacaccttgaatcacccactttcccagtggtctccctcagtggaaaataatttaaaaaccaaactctaagtggaggagtacttagttttactaggttggttactgttctaggatatatgtattttaagtaaaaatacatcataagttcatactgatactttttaaattgacattgtatattaatatttatggggtacggtgtgatacttcaatacatgtatacaatgtgtaatgatcaaggcaaggtaattagcttatccatcacctcaaacttgtcatttcttgtatttagaacattaaaaagtctgcttttctagctatttaaaaatacacaatatatttttaactatggtcatcctacagtgtgatagaatactagaacctatgcttcctgtctagcgtaattttgtatcctttaaccaacctgtggctacacccttcctggcctctagtaaccactaatctactttctacttccatgagatcaatgctttgagcttccacatgaagtgaaaacacgtgatatttggttttttgtgcctggcttatttcatttaacatagtgtcctccaagctcatccatgttgccacgaatgacaagatgttgttatttattctttttttttttttttgagatggagtctcgctttgtcacccaggctggagtgcagtggcgtgatctcagctcactgcaagcttcgcctcccgggttcacaccattctcctgcctcagcctcccgagtagctaggactacaggcacccgccactatacccagctaattttttgtatttttagtagagacggagtttcactgcgttagccaggatagtctctatctcctcaccttgtgatccacccgccttggcctcccaaagtgctgggattacaggtgtgagccaccgcgcccagccaagatgttgttattttaatggctgaatagtattccattgtgtatacataccacattttcttcatctgttaattcagtggttgattcaatgtcttggcccctgtgaatagtgctgcaataaacatggcagtgggtaaagaatatctcttcaacatactgatttcctttcctttgaatatttacccagtaatggggttgctggatcatacagaagttctacttttagtatgaggaaactccataccgtttttcataatggctgttctaaattcccaccagcaatgtatactagttctctttctccacatccttgccagtatttactttttgtatttttgataatatcttttctgagctgagattatatctcactgtggtttcgatttgcattttcctcatgattagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgattttttcctttgctgagcagaagcttttacatttgtctatttttgctgatgttacctgtgcttttgaggtcttctctataaaaatctttttgcagaccaatgccctggagtttaccctgttttcttctagcagtttcacagttttaggttttacacgtcagtctttaacccattttgagtgtattttgtatatggtgagagatagatgcctagtttcatccttctgcatatgaatatccacttttccaagcaccatttctgctgtagctgttgtcctcagaatggtctgcctcattttccagtagtacctgatgatgatcttgaacttcccaaactctcagaggcatcacgagtaacttggtcttgtctttactttctcacacgcagtttctaacaccacatgggatttatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgtgcacacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgtttattagtcagtgaattaagaggaaaatatcaaggagacatctgcactcccatatttgttgcagcactactcacaatagccaagatttggaatcaacctaaatgtcaacagacaaatggataaagaaaatgtggtacatatacacaatggagtactgtacagccatgaaaaagaatgagatcctgtcatttgcaacaatatggatggaactggaggttagtatgttaaatgaaataagccaggcacagaaagccaagcttcatattcccacttatttgtgagagctaaaaaaaaaaaaattaaaacaattgaactcatggaggtagagagtagagtgatggttaccagaggctaggaagggtagttgggggatggtatgaggtagtgatggttaatgagtacaaaaatatagttagatagagtaagatctaatatttaatagcacaacagggtgactacagtcaacaatttattgtacattaaagagtaacagagtataattggattgtaacacaaagaaagggtaaatgcttgaggtgatggataccccatctactctgatgtgactatcatgcattgtatgcttgtatcgaagtatctcatgtaccccagaaatacatatgcctactttatactcacaaaaattagaaataaaaaacatttttaactgatattttataattatataaattcataggtacaatatgatgtttttatatacatatacaatggaatgatcacacaactttaaaggaaaagacaattacccaacctcctttggaaacagaaatcaacagcattgttccttctggctgggtaccgagataagaaaggaaatctgtagaaaatcctacaaccaaggaaaagaaatatgctactaccaagaaaaagtgcttatggagaagttgtcataacatgatgaactgaaattatgacgttaggtgaataataaaagtgaaaacaaaatgtatatacaagccaatcataaaaatatttgtaaaataataagattgaaaaacttcaccaaagagttacagttgtggtgaaattacaagtgatctttgtcgattttattttatagtgtatttctgttttaacaatgtacaataaccaaaaggctcttttaaagaaataaaatgggccgagtgcggtggctcacacctgtaatcccagcaccttgaggggccaaggtgggcggatcatgaggtcaggagttcgagaccagtctggtcaacatagtgaaaccccgtctctactaaaaaatacaaaaaattagccaggcgtgctggcgggtgcctgtaatcccagctacttgggaggctgaggcaagagaatcacttaaactcaggagacggaggttgcaatgagctgagatcacgccattgcactccaacccaggcaacagtgcaagacgctgtctcaaaaaaaaaaaaaaaaaaaagaagaaaatgtttattttgtcagtattttatctttcaagatctagatatcaccttttccttcttccataaatactacaacctcacataggtattttctgtcctccaattgtgtagagtgctagtaattcaataacttagcatcaaaatcaccctaatgagcttttcagtgtgcatatacccgagtttccttccagcaccactgaatcagaatctctggatatggtacccaggaatctatattctgaaccagcatacttggcatcattgatgcaggaggtccatagactccagtaagagacattgtattagggactccacttttcactgagcacataatttgatacttactggtatggctgtttgttattgcagagcatgtctggtccctgcaaccagattactaattatgaaaaaacagaatctaaccctaaccctaacatggcccagacctcgctaaatgattttaggcattaggccaatacagatggcctaaagactttttatatttcttccttttataaaacattaattttgtaggtgcatatgaaagccaactcactcccatttataactcagaaactatggaagcaaaaaaaatgcagctagaataatgttgttttctttgtatactgttaggcacagaagtggaattccacctattcactaagaatagtagctacctgataacatccagttatccaaatgcagtaaaataaatgagggcataagaaagcaaacaaatacgccaaaacatatttcaagagtagcatacaaaaaatatctagtcagctctcccttaagctaaggaaattaaaccaatgaccccaatagaagaaaattattagacattcaaattctgtatatttggcttaaataaaagcaaagaaagatggagaaggtctcattcatgtgagatctgtttactctgcacagcctatgtcagaggtaatggtcttaaatagttttaggaggatctaggttgaactcagatctgaaccaggtagaaacacccattctaaatggagaaaattcccaagcatggagtcaatttaatacatttcgagagtttactctacaaaagccaacatctttccagacttggggcaggaggttctctctacccaggagataaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaatagaagaataccagatctcaagagaagtaggagcctgcatcactacagttgatgtcaggggcaggaatcaagagtgaagaaaaggagatgtcaagatgtctggggagtgtgtctctcctgaacactgaaggaaagagatccataggggtgtgtgtgtgtgtgcgtgtgtgtgtgtgtgtgtgtgtgtgacacagaaagaggtcttacaaacacacatttttaaatttttaatacataaaaacagtggacaaattataccactcaattttctacaatttgaacacatccatacaaccattttccaaaatcaagcttcaagatacagaacaccagaaaccttcctccagctcccccaagtctatatcaaatccccaccatggttgtccagccatctctctccttctctgtgtgtaccaattaatctctctctctctctctctctaacacaaacacacatttttagcaaagacaatgaatattcaaagagcatcttccatatgccaggctgagtgataggtgccttaaacaatatcatcttcacaacaaccctctcaagaagccattattatctccattatgaggaacagggaatttaaataacttccccaggttgagatggttagaaccaagccaagatatgattaatctcaaataagactaactatcggcccaggttctttccacaatactgcaggtccctccatgctcccacttttgatggaatgtagcccaagatcccccagaacagaaccatgataaccagacaggaggagggtcctacaactaactctcattttcccttcaagccaatattgaagacttgatatcttggtccattattctgtccaaataaggaaaggaaacaatgttgaatcttgatacgtgacctgataagactttggtgctctctgaacatccatcttctttgcctcaaaataaaaaatatagggttgatgaatgggcaaggcaatcctaagcaaaaagaataaagccaaagccatcacattacctaacttcaaactatactacaatgctacagtaacccaaacagcatggtactggtaaaagacacatagaccaatgaaacagaatacagaccccctaaaataaagctgcacacctacaaccaactgatctttgacaaagtcaacaaaaataagcaatgaggaaagaacccccatccaataaatggtgctgggaaaactggctatccatatgcaaaaggctaaatctggacccctatcttttactatatacaaaaattaacccaagatggattaaagacttaaatgtaagacctcaaactataaaaaaatcctagaagaaacctaggaaatactgttctggacattagcctaggcaaataatttatgactaagtcctcaaaagcaaatgcaacaaaaaaaaattgacaatcggaatctagttaaactaaaggtcttctgcactgcaaaagaaactatcaatacactaaatagacaacctacagaatgggggaaaatatttgcaaactaggtatccaacaaagggctaatattcagaagctataaggaacttaaatcaagaaaaaaaacaaataactccattaaaatcaggcaaaggacatgagcagacacttctcaaaagaagacatacatacagtggtcagcaaacatgaaaaaatgctcagcatcattaatcataagagaaaagcaaatcaaaactacagtgagataccatctcactccagtcagaatggctattattaaagaatcagaaataacaaatgttggcaaggttgcagagaaaagggatatttatacactgctggtgggaatataaattagttcagccccagtggaaagtagtttggagatttctcaaagaactaaaaatagaattaccattctacccagcaatcccatcactgggtatatgcccaaaggaaaataaatggttccaccaaaaatcccctgcactcatatgtttatcacagcactatttacaatagcaaagacatagcatcaacccacatgcccatcaacaatggaatggataaagaaaatgtgatatatatacactatggaatgctacacagccataaaaaagagtgaaatcatgtcctttccagcagtatggatgcagctgaaggccattatcctaagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacacgcgcgcgcgcgcgcgcgcacacacacacacacacacacacacacacacacacggttgatggaaaatgaatgctgcctctagatactgactcaacagtctcaactatgttcttacattggcatttttttttttcacctgtctccttctcaaaaggtcaagagcaggagaaatttcgcctaacagagtttgtaaggtaggttttggataatactattttcttattttaagaaataacttgggctaggtgcggtggctcacgcctgtaatccaagcactttgggaggccgaggcaggtggatcacctgaagtcaggagtttgagaccagcctggccaacatggtgaaacctcctctctactaaaaatacaaaagttagccaggcatggttgcgggtacctgtaatcccagctactcaggaggctgaggcaggagaatggcttgagcctgggaggcagaggttgcagtgagctgagatcacgccactacactccagcctgggtgacagggtgagactctgtctcaaaaaaagaaaaaaaaagaaataacttgataattctaagatgccgatgtcctcattaaaaggaaaatggaaaaaggcaaatgcctggtatttcttaatgaaacactacactcagcacattataggagttatcagatttaatgcttccaacgacttaatatcaggtagtattattaactccatttgcaaagaagggatccaagtcctagatagaggaaatggcatccccaaggtggagaaccagttcaatcttggtcctctggctccagggttcagctctgaattagtaagtggtcctacaggtaaaataaatgatatgatttcaagttgcaatcatggttcttttaaaaatagatttaagggatacaactgcatttttgttatatggatatattgtgtagtggtgaagtcttggcttttagtgtagctgtcactcaaaagtgtctattgtacccattaaataacttctcattcttcacctcctcccattcccctcaccttcgagtctccagtgtctattatgccaccctctgtgtccatgtgtatacattatttagctcccacttataagtgagaacatgtcacatttgactgttttggagttgctgcacttaagggcctcaacacatatacaccatggaatactatgcagccataaaaaagaacaagttcatgtccttcgcagagacatggatgaagctggaaaccatcattctcagcaaactaacataggaacataaagccaaacaccacatgttcttactcataagtgggagttgaacaatgagaatacatggacacagtgaggggaagatcacacaccagggcctgtcagggggtagtgggcaaggggagggatagcattaggacaaatgcctaatgcatgcggggcttaaaacctagatgatgggttgatgggtgcagcaaaccaccatggcacatgtatacctatgtaacaaaactgcacgttctgcacatgtatcccagaacttaaagtataataattaaaaacaaaaaagataaggacgtcaagttccctccatgttgcttcgaaagacatgatgtaattaccttttatggctcagtagtattccatggtatgtttatatcattttctttatccaatgatccgttcatggacacttgaaaagatagggaatcaatccaagttgcaatcctggttcttaataagaagccttctcagaggataagctagtttatagaggaagctggatgaggtaaagaggaggctttataagtctattgtctctcaagctgatgttcccatgtgaagatggaacagggaagacagattctatttgctcagcagaaaaggccaacttcactctcagccagttgttcacaaacagcaaattgtttctgccctatttctttgtaccatcaaagaaaagaaacaggccaatatatttctcagttcccaaagttaaggagaaggtgtccgtggtgaaaataacccgcctcgttttagctccttccaccggaggcaaggaacaggaccaactaacatgttttctgaaacgaatgctctggatatttgctgatggggcaggttataaattgttcttgaatttatgcagaggctcactttgcatcaaccagggctaataaatcaggatgcagagaaatcaaggcagctgtgcaaaatacagttcacatggaagtgtggacagtggacaaatctgacacagagagacaatactcggctatgtaaatcggtgcataacataaagcacaatgtgcatactacctgggactgaaattatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctcatctctaccaaaaatacaaaaaaaaaccccaaaaaattagccaggtatggtggtgcacgtctgtagtcccagctactcctcgggaggctgaggcccaagaatcatttgaaccctagaggcagaggttgcagtgagccgagatctctccactgcactccagcctcggctacacagcaagactctgtctcaaaaataaataaataagtaaaaataaataaaataaggttggatatgggggttcatgcctgaaatcacactgttttgggaggctgaggcaggaggattatttgaagccaggagttcgagactagtctaggcaacatagtgaaaccccatctctacaaaaaaatttttaaaaagaaatagcagagtatggtggcctgcacctgtaatcctacctacttggaaggcagaggcaggaggatcactgtagcccaggaactcaaggctgcagtaagctacgatcatgacactgcactccagcctgggtgacacgaagtgagaacccatcactaaaataaaataaataataaataaatctgttttattttgttttccctaaaaattgaggctcttccattttaaatctctcctgtgcaatgggcatgcttccctcctacattgcaggttgggaaacaaagacacagaggaaatgggtggcttgcccaaagtcacccaaaaactctgtcagagagagaactcagactaaaacctaaatctgcccctaactccaacccccattcgtaaagaccccagtctccaagtcaacagaggcaagagatcccaggtccatcatgagtcaggacaggcggctcatgtggggaaaaggatgcattctttgtttttgctcctggctcagatttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatggaatgaatgatctagatcttcaacaataggctcatttttccaatttccaacgcgaactgctgaagagggccctgcacctgtcagaatgcaaagcccatttgtcagttcctggatagtttctttcagctatttcaaggggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccccgagatgttaacctctgtgtgtcaatgaagcagggaaactggacagttggttcacttttctaaatgcaggagcaagatgagggaaattattgatttgtatcaaaacagacaagaagcaaatagaagagaagaccatgggcagggaagggtttgaatacaaatggaaaccaccaggcatagcattgggagcttctgaactaagtttcaggtcagaggtacctgcgtcaccacagcatggaaaaacgtaagggagaattcttggctcaccatctccattggaactcctttaccctgaaagtgctttttccagtgtctcctgttgctatggtaattagaggtattcctggctgggatcttgatgatggtgaataagcaaacaaacatacaacctcatttcatctggttttaagggttaacaagcaaataaatgcaagctaaggtgatagggtatgacaagggaggggaggggctcttggagactgactcggtcaaacagacacctgaaaagtccagggacgagctgaagaatcccctgagactgggagaaaggaagactgttggtccttggtttcatcaaattcttcaatgtatttcctcctatcatccccttaaggttaagagtatctgcaagagagaatggttagagaaggccactctgaggaagcagcatctgagctgaggcctgaattataagaaatcagccccctggagactgcagagggtttggaaaagggaagagggaaagcaaggctaagcccatctaagacacaaagaggtcaaacagcacaagccagatgtggtcaagagaatctgggggacaaacaaaagaagagacatttttaagcaggttcatggaggggatagatgacgaattaggatttttaaatggatttctaagcattaatcccctcaggtttaataaagacaagaaggttgttgctgttgttgtcgttggtggtggtggtggtgttttggtcaagatattgtgaagaagaccagccctttcaggctacagtaacacaacttccaaggagggcttgggtacaagtgagcaaaggaaggaggggtccaaaccagtctattcactcccagtcataatgaaacttccccaaacacataaatcacccaaggtcccagtcatctaataacacctctgatctcccagtgtatgctatgcttataatgtttgtgattcttgcacttacattttccaaagccctcatcccctttcctttgagtgggtccccctatatcctcagtatgctttttcaatgcaagggataaatgacccccttaacactagcttccatttaaagaggggatagagaagtaaggcttatgggatctatgtgggatcatcaatgagtctaagataataacagagggatttgcagggaggtagagaaataaactaggagagctagaagggcattgaccaagagtgagcaaagaggtaaaacaatagatcaaggaagaaaaggaataggaggaataaaaagaaagcaggcagagggtggcaaaaaaaaaaaaaaaaaaaaaaaaaaaagaaagaaagaagtaagagggaagagaacagaaggaaacagagaaaggaggatttggaaagtaaagaaactaaggagaaagaagtatggaaataaaataataaaagaatgggataagttgaatgtcagaaagagaagatgcgagccaaccaagaaaatgacagagttacgtagggtggaagggcatctccaacaattaccccaacctgcatcataacctgcctctttcaccttccagagggagcagacctcattctcttctaccacattgcattgcgtgaaaccactgctgacactccctcccacgatgcaggctccctgggctcccctgagcagctattctttcagactcaggcacgcatgaaaattgagttcagctaaatgcaaactgaactccagaagacctgctcctacccatcactgtaatcgttaagggagaaaattaattgcctgaggccagagtgtcgaaatccaactagacatctcctcccaagtgacctgtccctgagcagattgtggtgggcacacctgtaagtaatattccaacttcatttgtctacacataatttcccttgtcaggatttataatcatatacacatagctgttgtggtttttatggagtttctgtctttcccaatacaccataagctccaccaatgggaagaggctatacctattttttaacactacagcacctagcacatagactaatcactcatcaaaaattctcaatgatggagagatgaataggggtggggatttcaaaccaggactcacagttcttaacaaagaaaacagaataaaaataaaatgttcatttttctggtctgattcctctaacaccaggtgtttttttaaatcataaaattatctctcacatattaagtagctaattgctatgacatttcaaacaaaaaaacgccaacctttacacaacttaagtcatgctctttcgttcctttaaggaaaccatgatttttttcatcatcaccagcccaaaaatgtatcatcctgacaacacagaagaaaaaacaacttgattaatcttggaaaatttcctccaaaatcgaaacactgattgctgagttaaaactcaaaacaggagctctgtcctgaactggcctgtagactttctaacactggaacaaaccagtaatcactagtgttggagatgctataattgaagtcagcttatgacaacagggaaaaggctgagtctaaaagctctcaccattcaacactccccactcccaatgttcccactccaaatggtacagtaatggtgtgatgataggtccatccagattctatcccgggggatctcttcctgtgtgtagccttccccctacactttttcttggtatcattgatctccttctgtttttcctttcttttcatgttttctttcaatttgattcatttatatacacatatgaatatattctcctttgataaatccaaacattaagagacaaagctaaagccctcttgactgccatccctaatctcaactcatccccaacatcgaccattcttgtgttacatgtttgttgtgtatccactcaaacctctgtctatgcattgatgtgctaatatggtctggctgtgtccccacccaaatttcatcttgaatcatagctcccataatcccacatgtcatgggagggacccagtgggaggtaagtgaatcatggaggtgggtttttcctgtgctattctcatgatagtgaataagtctcacaagatctgatggttttataaagggcagttcccttgcacatgctctcttgcctgccaccatgtaagacatgcctttgttcctgctttaccttccaccatgattgtgaggcctccccagccatgtggaaatgtgagtccattaaacctctttttctttgtaaattacccagtcttgggtatttcttcatagcagtatgaaaatagactaatacatgtacctactacatttatttatagaattataacacctcattccataactttttacacaaataataggttatgctttttgttctataactgtctgtttttacccaaaaacatgtcttggagacctctccataccagtatgaggctctactttattctactagatgaatctttcccatggtgctcatgtgtcatgggttagccatggcactgcgattgatatttagtccatatctgttgttatataagagtggcatgaacctcgaaaacgtcatgataaacgacaggagccaggcataacactgtatgattccattcacataaaatgtccagaataggcaaatccatagagacagaaattagattattggttgccagggagctggaaggatggggcatgttgtgtgaatacttaatagatacagaattttcatttggagtcatgaaaatgttttggaagtagagatcgaaggtccttgcacaacattgtgaatgtacttaatgtcactgaattgtactctttaaaatggttaaaatagtaaactctatgttatgggcactttactgcaataaaaaacatagaactgccagatcacaaagtatgctctttaaatttttataaaaattggcaaattgccttgcaaaatcttactccctttatgtttttgtattactgtatatatctctatgtatctttctcaactaatttcagaatcagtctcactcttctctctctctctccttctccctccctccttttctctcccccttgccttcctctccaactctctaacagttctgacaatagtcacaaatactcctcctccccctcctgcaaaaacttttcaggtcatgtatcagtttcaattacatgcattgctttctccttcaggacttcctggatggcttgctgagggacataaacatcctaggggtgcgggtagggggtgtggaatatacaaagaatccttatttctttagtcagctcagagccaatggaagcattacatcagcagaacaaacaatattaaattagaggttccaacaactcacaattcctattatacaagtgtagtattttcctccaaacagcacagaaacttacactgaaagcagcttcccaggcacctgctggcccaagaaggatgttcttatgtcaaagagtttccagctatattagagaggtagtagagtcagtggttaagaatccaagttctggtatcagactgcctgggttcaaatcctgactcaactgcttaactcaagaagtgaccttggcatattaaacttaccactctaaacagcattttgtaatctctaaaatgaaggattgataagaatcaagctgtccatcaatgagactggataaagaaaatgtggcacatatacactatggaatactatgcagccataaaaaaggatgagttcatgtcttttgtagggacatggatgaagctagaaaccatcattctcagcaaactaacacaagaacagaaaaccaaacactgcatgttctcactcataagtgggagttgaacaattagaacacatggacacagaaaggggaacatcacacactgggcctgtcaggggttgggggctaggggagggatagcattaggagaaacacctaatgtaggtgacaggttgatgagcgcagcagaccaccatcacatgggcatacctctttaacaaaactgcacattctgcacatgtaccccagaactgaaagtatatatataaaaaagaaaagaatcaagcaagatacggaggctaatcactgatcacaggctctcacacagggggtattagtttccatttgctgttgtaacaaattccacaagcacaacgacttagaataacacacaattattattctgcaattctgaggtcataaattctaaatgggctcactaggctaaaaatcaaagtatggacaaagctgtgttcctccagaactctaggaaagattccatgtctttgcctttccaggttccagggagttcctgcattcctcccctgagcaccctcattattccacctctgtttcctctaccttcactatacatctcctcctctgactctctccctcctgcctcctttcttcccttataaggacccagtattattacactgggttgacctgaatagtccaggataatctccccatttcaagagccttaacttaatcacagttgtaaaatctcttttgccaaattaggcaacacatccactggttccaagcattagggcatggacacatttggtgagtccttctcgtaccacatgtgaagaacatgcatgtgttaaccactgcggctatttctacactactcctactattacagagaaagaaagtttttttttctcctcctaaaaggaaaataagtagcagtcatgtctcagctatcaagagaaagggtaaaaacctataccctcattccttgaaattcctctaaaattacttaatatattgcttttcttccaccagtgggccacttgttggaagtcctaagcagtgagttatgttctaaagcactattaatagtctatagagtcctttaaggtactttagcatggaataagggaggaaacagaggagagagaacagtgttctgggtaccttggcctaccggatctacactgatttcattgtattaaggaagacaaaaaaacaaagattcttccctatccatcatgcttctttggttttggacagcaccttgtaaatatcattttcctctttctcctttttcttctcttccgctgctgtcttcatttatttatttttctatttctccagaaatgggtgcaatactgcatatcttcagcttcttcagttttgtactcccattactttggtcctagtcttggttatactcaaagggcagatttcacaaatgaactctagactcctcctgggcccaggaagtttgtcctgcttaccatggccataatctgtaggcaatgactctccatccctgagacccattaatttaactaggatgataaacagaaaaataaataaaggtgttgtgatatggggaagaaaagcagcatactgaggtcagcctaccttacccgtgggccccaattgtcctgggcaagttacttttcctttcttcgcctcagtttccttatctgtaacatcagaggctgagcaggatgatcttgtgggtctcttcaaactctgagattctatgagtctatacaaagagtgtttatccaaaccaagaacagaggagaagaaatggcaccaatattggaaccatgaagtcctgggtttaaattgtggctctattatctactacctgggtgcatctatcaggtaggattcacctggttgcaagtgacagaaaattcaaaccatcttaaacaatagagatacataagcttctgtgactggaatgaccagtggcaaagatggcttcaggagttttcaagtcagtagaccaatgatgtcatcaagattttgctccttccaactctctgccctacataccctctgctgaaactatcttatggctgatgccccatcgtgaacacaacatgggaacctgccaacattccacaagtgcttccatgcatgctcttgtatctttagaaggttctcagaagccctccaataaaatctcccatctcatcgttcttaactatgattcatgctaatcaatgagccagtcaccatggccagtgaatcagaattgcatggattggcttaagcctgagtcacatggcctgcttttaccaaaggacatgaaattcatggggtaggcacggatatccaacgggaaattatggcagttaccataagaaaaaagagcaaatttgaggagagacaaataaaatgtccaccacaacggcctttgagaatatatttaacttctcttagtttcagtttactcattgataaaccaggataacacctacctttaattaggattagatgcagggatatttatcaatcattcattctggcatttagtttaccctggcagcatttttctaataaaatgtagctactaatatcatcattattatcagcaccattaccactagagaaaaagctatagaaactaacacagcttcctttggctcttaccaggtgaaccttgagaaatctctgagatggcctcatgtatcacactagagcttgcaaatggcataaaataatcagataaaacaaggtacaagatgaggaggcatcaggttccttaatgctttaacatcagctcagtgcaaatggtgaactgatagttcctctgagcccttggaaatacaatggaaatcaagttttggagaaacagaataatcaaaatgggttattgccaatagatctccaactaagggacaagaagacataatagatgaaacacctaatctgtggaatacattcccctagggagagctgaccacagatggaatggctattcaggaaggcaatgagaaattcatctctggaggctgaatgaccggtttcacggattaggtgggtaagagaaggaagtcagtgtagtcatctataggtaccttcctcacagtaagcctggaactccatgagagaagttggaaactgagatgcctacagaaagcacgcaggcaacaaaattgagcaaagtagggtgtgtagagtgtgagatgagcgaagggttaccaccttatcccaaggggcaatgactacacaactccagcttctgtggtctgtggccatagaagaatacaacttgatgttgccagctctttcagtatttcaagacaatccagaattcaggattttgtgttaaaatcttcctattttaacagttggtaaaccatgcacatttaagattttgtgtaggacacatttgtgaacgagagtcacccaatggactttggagaaaggcatttcatggcctttaggagaaaggcaattttcctactggaaaccataaggccttttattcttgtcgaaattcatcagtactttgtaaaatggaataaacttttaagcattaactagcagaaaaatctgccatattgctgctgagtgagtgtgtagcaactgacaattatggacagtagaactcaaactagctcttgatgcatgggaagcgaatacgaggcaatcagtttaaaattagaaccacatttcttagaggcctccatctgtcttcctacatggggagtatggagtccctgatccttcatctatttttgagtggccctgtccagatgaagagcagaaacagaaatcctggattctgattccaatgggagaggcatggaatggtcaaaagggtggtagaagaaagagaaaaacccatgtggaaagtgttcacagcagtaattaccataaaggattccagataagatatctattatgcaggaaaaggaaaagacatcaagattagctagggataattaaagaacaaagttagtgaattcaggaaaaagctggataggcctgctaaaagattaataaaaagagaaaaaacgaacagagatgaccatggtattgtttgcattattttggatatggaaggcaggaaaccaagaacacagtgggagtataccaagtagagctgagttcttggacaaggctgaaattgtgcacactcccacttctggttgccttagcaatgagactcccactttatacgaatgacatgagaatgagtaaaaccttatgcaaatgaagcacacagtaattagaggcagagccacatggagtctagatgaggccatgtcggcagaatatctagggaatagtctgagtgggcttatgcagcaaagaatgaggtcattaaagcaaagacactgagctatgagtaagaggaataagtgcttgagaaagactgtgggttccacagacttgttggttctcccactgattttggtcaagttatttcaggtaatggatcatgcagtcacacgtccgcattgcctcacctgctctattttactgtgtctctcctgggaagaaatcttggaaaagggtaagaaggttgtttactgtcctggttccctgtgtgtgctgcctctcactattacccatgaaagggaatcaaaagggggctgggaaagtttcacggagagggttgagaactcacaaataaagaggacaattaggcccggcatggtggctcacacctgtaatcccagcattttgggaggctgaggcgggcacatcacgaagtcaggagtttgagaccagcctggccaatatggtgaaaccccatctctactaaaaatacaaaaatcagctgggcatgatggtgcgcacctgtagtcccagctactcaggaggctgaggcaggagaatcgcttgaacccgggaggcagaggttacagtgagccgagatcacaccactgcactccagcctgggtgacagagcgagactccatctcaaaaaaaaaaaaggacaattatgggatgtttcttacggctgctgtaacaaattactacaaaccaggtggtttaaaacagtgtacatttattccttagagtcatggatgtcagaattcccaaatcagttgcactgggctaaaatcaaggtgtcagcaggggtgtattctctgtggacactctagggaagaatccaattccttgccttccccagttcctagaattgtaatcccagcattccttggttcatggccccttcctccatcttcaaagcaagaagcacagcattttcctttggtcatcaaactgtcatcttccctggtagtagaatctccctgtctttccctgatgaggacacttgtgattatattgttgggtccacttggataatacaggaaaatctccccatatcaagatgcttaacttaatcacattggcaaagccccttttgtcatgtaaggtaacatactcacaaggtcaaggaattagaatataagcattttgagggccctttattcagcctactacacggggcaagagagagtagaagtggaaaggaaagacaattttaagaattgttacttaaagtgcattataaattagatgcccatgaattttattgaaaagacaaaagtaaaacgaaaatttatttttataaaagctctgtgtttctctgaatttacaaagttttgaggctagaatatatggggcactggtaagtatgtaggttacaagcatgaatcaaataaaataatcatttgaaaaaattgcatctagcaacatgcatcaaagtaattagtttaagaaattacttctttgccagcacttattttaaataactattgatataaaaagtgacagcgaagatttagatatcagaagctacttatattctgggccaatgtacccttaaaagttgatttctctcctgctttctctcagacaactgctgtttatatttgtaagcttgtgcaattccacaaactaacaaacatgagtataacattttttattactcacattaactgctatttttcaatccaaaggaaaatgaaggagaaatttcagagcgatggtcacaaaaccaaattttataggggccaagtgtgtaccatgagtgagtgaagtggtccagatacgtaaagaggtaaactgggggggtccacgccctacctggagaaaaagatattactcacttccatctgaatactgccatttcaacagacagtatcactggagcttttaaatctttaagagaagtcaaatatccagaatttcatgtaacatctcctgatttgtaaatgttggagactaagtcaaagcaccatgtgggctgaataaaactcattcatcctgtggcctgtcactttgcaaattccattataaattctattaagtacttttcactttttaaacctaagacaaaaaggggaagttttcatccagtgaaatgacatgatcacatttgtgttgaatttatttctaatgcaaccacatatacacagtgacacacacatttacacaaacctctgagtgtatgaataaactacctttgaaaccataagttcttaagggatagctttttacctcaatattacagctttggccagcactgagcaaagactgttttcctttcagtgaagatctatgtaaggatgtaggctgttgtaataataacctacttcatataagagaaaataagctcccaaatacaatgtgattagcctcagtggtcaatctaagcacaattgtcccaggaacctggacaccatcctaactgcagtcgtagaagtcaccaactgtgctctcctggcccttggtcaggactgcaatgaaatcgtctcaggcaaaggtgcatgcacccagatttttaaacccagtttttttacaatgcaacttcaacatctgcatcaataaataaaccacgtgaacaaccaaaacgacttttttagacagtgagaagagctgtgtgcaagacaaaatgggccatgagatagagagtgctaagggggagcggtcaaggaggatctatcactcctaaagagatgacattctggctgtggctagaagaacccaatcatgtaaatttcattttatttcttaaaaaatgttatgggtacatagtgggtgtatatatttatggagtacatgagatattttggtacaggcatttaatgcataataatcgcatcagggtaaaatgaggtttccatcacctcaagcattcatcatttctttcaacgttcctattgtactccctcagttattctaaaatgtacgacaaattattgctgactacagtcaccctgttatgctatcaaacactagatcttacgcattccatcttaactatattttttacccattaaccctccctatttcccagcaccctctctcacaactacccttcccagactctagtaaccatccttctactctcttctgtgttcaattgttttaattttcagctcccacaaagaagtaaaaaacatgcaaagtttgtctttctatgcctggcttatttcacttaacatagtgaccttcagtttcatccatgttgttgcaaatgacaggatctcattctttttatggctaaatagtactccattgtgtatatgtaccacattttctttatgcattaatctgttgatgaacacttaggttgcttccaaatgttggctattatgaatagtgctgtaataaacatgggagtgcagatatctcttcaatatactgatttccccttctttgggtatatagttgacagcggaattgctggatcatatggtagttctatttttaatttttgaggaacctccatactgttatccatagtggctgtattaatttacatttctaccaaaaaagtacagggttccccttcctccacatcctccccagcattcatcattgcctgtcttttgtaaaaaagtcattttagctggagtgagataacttattgtagttttgaattttatttttctgaccattagtgatgttgatcatgttttcatagacctctttgccatttgtatgtcttcttttgagaaatatctattcagatcttttgccaatttttttaattggattattagatctttttcccattgagttgtttgagctccttaaatattctggttattaatcccttgccagatggatagtttttaaatattttctgccattctttgggttgtctcttcgctttcttgaccgtttgctgtgcagaagttttttaacctgatgtgatcccatttgcccattttgctttggttgcctgtgctgtcggggtccacgtaaattttaatttagggggctaaaagttctcggtaaagggaaatagaaaagcaaatggcctttgacaggaatgaacacatagatgtaagtgacaagaggctgtgtagctggagacagatttgaaaggaagaaaatatgattgacttggagacactgacatgggcagataagaacacaggaggactttagaatggaaggtcctaagcaggaaggacagtcttatttgtatctttaaaaaagcttactctgacaagtcattctacctctttgagcctctggtacatcctctataagatacaagtagtattctttttttcacagggctcttaagaaagttaaattcgatcttggacagaaagtacatggcatacagtaggcactctatgaacatgagctgaacttgaacatcttggggggaagtaataacaccacagagaggaggcagggaatgaaggtattggagatctgtcctcttgagccttgacggctcctgcttctaagagaggtcatgatcttatgacagtgccttccccaatccccttatttggatatcccatggctatgcaacagctgtgccccaactagtaccccatggtggcttccaacagcaaaactaatttggttgtgtcatgctgagatatccatcttctaatacaaatgtaacagattagcatacaaagaatggactgctgttgaccacagggagtagtaagactaactttaagaagcttgaacagcgtgcagtcactcccctactgctgttgttttgtagagcataagaagtgggtggagttgtttccaacaataacaatcaaaggaccaaagaccggacccatgagcactgtgattcttccctgagcatacaataaaccaactaggcaatgtttacccaaaacagcaacataatctcagaagcagcagttccacacataggtaacttcctataggtactcacacttttaggcagagatctgtgcaaggatgttcaaggcattttttgcatgtaatgtcaagagattaggaacaagctaggtgtccatcagaagggaattggtcacatccattagggtacattttcaccatggatgcacattccatgcaactgttagaaaacaaaactgatttacaggtaccaacaaataataatttgaaaaacatggcagtaaatgaagaaagcaaggtgtagaacagagcacagagttggctaccatttgtgaataaaaagtagtatatttatttgttgggtctttttggtgccagacattggagatttagcagtaaacaaaacaagccctggctccatttagcttacactctgatggagagagacaggcaatacactaatacagatgaaaatacgttatatgtcaagtgctgataaagtcccgtatttatgctggaatttgggtgaatcatgtcaatttgctggtaagtgaccactttgatccataaagaaggtgattttgaaaggcttagccaaatacatactcagacaaaatgatgtacaagaaacagcaattcctccaggaaggaagcttagaagaaaaaatacttgctagacacatacagatgctgatttaatttttgtaatcccatgtgggtattgcctattcaaaacaaataaatatttttaaaaatgtaatcatagaaacacaatagagttgacacacagagaggtagaaggtaggtaaggatgaagtgaggattaggagctaagaagaggtgaattttttcaatgcaaaagtaggcaggtgagagcgacatactgtaatagagtatgcgccactcgaaaccataagtgcccttttatttgtgattcggctcaattcccaaggacggcacaacccctagactcagaccaggaaaggcagtggtaacaaacagggagacctggacaggatgggggttgcaatagagtctgtgcctgagctcacctgggcacccaccccacatgttcctcaagggtcttgcttgcagggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagacaaaccagacagaaagaagtcacgtgggaccacaatgaacaagaggcagagacaggccggatgatggccaaatgcacaatgaaactggaactgaggttcctaaagatgctggcacagcgttgcacagtcacttgtcttgggccagaccaaagcacagtcccctctactctacgagtgaggagcaaggcccaaagaaacaagcacgactgtgaattctgtttgaattcctgctttctactccctagtactgtgccctcaggcacatagatgaacatctcagttcctttctcctttctgataagggtagagaacagcaaggcctacctggttctttccttattttattattatcaagctgttcatttcagcacatatatctagcttttactttgtacactaatacaagaagaatcctcacctaggtgagtttccacagccttatttttcttagtcctccagagttttcaagagaaccttattccacagacaggaaaaataactaatgggtactaggcttaatacctgggcgctgaaataatctttactacaaacccttgggatatcagtttacctgtataacaaacttgcacatgaaccctcgaacttaatataaaagttttaaaaggataacatttggaacctggagagcattagcaatagtacctacctgtaaaaatgttgtaaaattaaataagatcatgtataggaactgtttaatatacttcatagtactttataggtacttcataggttcataaatgcttcccaccgttattattgcactgtgaatactatggatttgcagcattaacaagtgatgactaggactcagctcagagaggaggagaggagaggctactgaaggttcatgcctccacccccaggtacgtgctgaaaaaggaatatctccccttgctcctccagaattcttaccttgtctctccagggaggccatgtatttatactgcactggtctcttcaccaggactgctatgctgcacaactccagggggcagcaatcatattatatcctgtgagcatagtcctccaccccacccttcacctgaagttgtggaacatggtgtccccatgtgctaaacgttcaggcttgctgggttattcctgtaacatttgttctatatcccagtccaacttttcatggtgacatccaaagttcccagccaccaatgccagactcttctttagcatcagtaaccccacaaacaactgggaagaatacttatctaccttccccactctttcttatttatgaatcagtttgaaattacacggtaatagttgtgcctgcattttgaagatggctcttatcagtaattacagatgtatgttaaactaagtttttaatgctaagattatcttcccaggtgtttacattagaaagaattctagatttggagataagtggagacaagttcacccctgaatatttagtaaggtgctaaggtacctgtgggattgcctgagttgtgactcttaagacattgcaagtaaaaagttacaactgacatcagcatccaaccattcttctgtaagtagcaatattctatttccttttgccttggtgggtccatcagtctacgtgtctactctcccagggccaaggcgggacccaaatcaaccactcattctccaaacatttccaacacaggaggaaaaacacaaggtcagggccgattcactgactgctgtgtgctgaagtaactgcctgtcagatcctccttcatggatccctagagaggctctccttattcattgcagatgcacgctttttgcagagcacccttgaaacatgctaattaattatttttttttaatctaagttacccagtgttggtttcatctacctgctgccctactgcagaatcagaaagtgggaatctgctttgtggcgggatgacgttcaccaagcatcgttcagggctggttcaccatgatgcctgtccaaacccctgagcacctagtgtctgtaccacacatgtaagtacttaatcacatgctacaccaagctgctcatagtttcaccctataactcttgtctctgcagacagacaaaagcttttctggaggctggagaccatagcatagataagaggtcctcaaaactaatggatcatgagcagctgtgaggtgtgatgcactaattagttaggatcccagtccaatcagtgatacttggaaatgattttggctttttttgtaagctacagcacattcaaggtcatttctataataacatcattcttactcatttacaatctgaaatgttttcttgagtgggagcgaaatggaaaaagtttttaatgtgttatgctttgtcttacatattctttaatcctgtacagaacagagcacagattcaatgttgaattgaactgattatgtgacatcctgcaaacaataaaagcatcacttttaaagaacttaaagttccttctcacaccttttatacctgatctccagcccctcaaagggttgtattaatgcatttaaccctcatatgctaaatttcatttctaattataggataaccacaggaaaaatggttatccagaccagccctttaactcaagaatcacaaatgcaacatctagcatggagaagcaggtaaagaaaataatgtaaaccttgttcaatcgattctaaaagggtggccatgtgggacaggcagaacaatggcccccaaaggtgtccatgtcctaatccctggaacctgtgaatatgttaccttacatggcaaaagggactttgcagatgtgattaaggtaaagatcttgagatggggagaaaggacatttgaaagtagagtctgagaaagatatttgaagatgccctggtgctgccttggaagatgaggaaggggccttgagccaaggaaatcaggcaaggaaaaagcagcttcttcccctagagcctccagaaagagttcagccctactaacaccttgattttagctccatgagacccatttcagctttctgacctgcagaactgtaggataataaatttgtattattttaagccagtaagtttgcggtaatttatttcagcaataggcaactaatacaccatgtatcaactgcaaacaattgttgcagttctagaaagctggcccaatttaccagttcttgggtgggaggcggtagaggagcagaaaagataacttttgagtactgagattaatacctgggagaggaaataatctgtacaacaaaccccagtgacacgtgtttacctatgtaacaaaccttcgcatgtacccccaaacctaaaataaaagtttcaaaaatctggattttaaaaagagatccatccctagatattttcgtgaatactcattggatttttacagcctctgaggtccagggtgtatctatgggctggattcagcccataggctgccctttttcctctgttcctctcccacgaaagccttccccttgctttatcctgaagaatggccatccagccttaagcatccacatgatggcagctgactgccttcctaatcatcatcccaataagtgagagctttaatatttcaaagggtctgctctcaagcacagctaatttctctctcccttatagcttttgcccacaggtcctactcttccctgcgggacagtaactagtggctcttgtttctcctccacaggacagcccttcgtatgtttgaagactgctctctcatgccctctgcctttcttcctgagaccttcctggaatcatagctcttctctctgtgctcattctgtctgacccttctaaaacgcaaagattggtaccaaccagcatcctcctgggtcaggagcaaggacagcgaaaccatgaccactgaagtgtttctttttaactacaaatcatctaaactctccttaaaattattcaatctttttccaggcaaagagattttctttggtgaagagaaaaattgcttaaagtggtttgacccacacctctctctctggcctccttcctcttcctagaaatccagctattgattcagcttctactcatgcctgtaatctcttgctcaagcgtcacttcctcaacgaagccgtctcagaccagctaccagtctgggtcaagctcctctgttgaatgatattttcctttagaacattcagctctgtctgtaattacacacagttactgtgacttcgttatttgatgcctgtgtccccgtctagattgataagctctgtgagagcagagtgcaagcctgtatagcctagcccagctaataaatgggtaggtggtgagttgtgagtgaatgtgtaggggagtctgacttgtcaatattctgctttattatcagaacaaatgaaaactccagtttttggtcattttcatatggctggataccttccccttctcaacctggcacttgtagaataaattttataacctaaatgcaagaccagtatgtatgtctcttaaaggataccttgacaactttaccctgcattctagtttagtaaaccatatttgaagcttgatttcattggccactatatgttcttttctcctggccttataaatgtacacatttcttagaaaactcgggtcttcattcattctacaaacatgtcttgagtggctactatgagccaggctcagagggtagctgaagataaataggtaaacaaagcatgagccccacccttagattactcagtctagcaggacagacagaggcataaatggaccactctgaaaccaagtgttgaatgccattataaagaaagttgggttctgtggtgtaagtaggagttaacgagatgaggatggcacaggagtcccagacaaagggaaactcattaccaagaaatgagggtgtctcaagaagtgacaaccgttttaagtcatttaaacataggtcagagtggagagagacaagcctagaaggccatgaacaaagagacttatgcagtgagttaagcaatatggactttatcaacaagtaatgggttattaataggaacatgacatttatatttcagaaaaaaaaatttagcatctacaggaggatgagtgaatagaaaagcaggaggacattagaaggttgttataatcatttaaataagaaataactggacaggtgtggtggctcatgcctgtaatcccagcactttgggaggccaaggtgggcagattacctgagatcaggagttcgggaccagcctggccaacatagtgaaatctcatctctactaaaagtacaaaaattagctgggcatggtggcacatgcctataatcccagctactcgggaggctgaggcagaagaatcacttgaaccgggaggcggaggtcgcagtgagctgagatcgcaccaccgcactccagcctgggcaacagagcaagacttcatctcaaaaaaaaaaaaaaaaaaagaaaaaaaaaaagaaaaagaaaggaaaggaaaagaaaaaaaagaaataactagaatcttactaagggtaggaggaaagaatagagaggaagaaaaagacttgaaagatccacaatgtctataaaacagatctaagtacagagacctgtggcctacctttggagacctacttccaggtgacttattttaactcagtgacacaacaactagttcactcaggcaaaataataacaaaaatatttttttcaaaaaaagactccctgattccgaatgcgctttaaatttctgaacatacttacatttggaaaatcattttgcaagataggcagtttgcactagattcatttgcatgtatataacattgcagtgtaagctttcttctaagcattttcacctgcttcatcacccattggctgcattcccccagcaaacatttattgggaacatactatttacgaggtgatggcaactgcaggggacagggaggtgcaacaactcagcccctgcaatgaggcaattcaccatcagtgtgggaaatggacagccacacagaacctcattaaaccatgtggtagggtagctgggcatagtggctcacactgtaatcccagctctttgggaggtcgaggtgggaggatcacctgaggtcagcctggccaacatgataaaaccccgtctctactaaaaatacaaaaattggttgggtgtgatggcaagtgcctgtaatctcagctactcaggaggctgagacaggagaattgcttgaacccaggaggtggaggttgcagtgagccaagatcatgccattgcactccagcctgggtgacaagagtgaaactccatctcaaaaaaaaaaaaaaaaaaaaaaaaagtggtaggcatggcctgagcacgggaaacccagggtaatgtaagaggcgcagagaagaggccccctaattcagcctgcaatggtgcagtggagtgggggacagtcaggaaagacactttggatacctgagcgttgtttggtttcccatgtagcctgtggacttctcatggtacatgtttcatctgtcaccccatccaacaatcagcacacagctcaaacaagatggggtcagatctccacttcatacacactggatttccacacatgcatgggaaagaaaagaaggactattgccccacagattcactgcatctagtattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtagttgtgtttttgcaatagtttctctcccccactgggtgattattcatgcactgcttctccacattagggcaaagtgagctcacatctctcttacctgctctctgggcctcccggcctggactcgcacaagggcaccatcccactacccctcatacttccaatcagtgcagaccagagccaccccaaccccactatcatcactcacatgagcagcaggatggagctggcacagaagacaagcctcctacacctcctctgccaaatcttcaaatatcatcagtcacactggaaaatggccccaggccactgctgcttaatgggccatgatggatgaacacagatctagagaaatgattgtttaccaactaagggatcagagcctatgggcctctttctgtcctctgaagagcatgctgctactggggcaaatgagtttgagtccagagccgacaatgagcaggtgatcaagccccaagtgaaatggcctacaagcccctcatcttctgaccacaaaaacaccataggaacatagagacactgccatttttttaaaaggaaccttatgaggaatacagacaaagaaacagataatcattacacattaagataatcattacacgattaatagataatcattacacgttgttaagtgctacaatggcagcatgatagggcacttgatgagtcttggtggggcggcagtcagagaagactacctgggggctggggatcatgaaagaaggcaggaggggaaatcatttctgcacaggttacagtagactgagtgcatgttctagagccaaacagccttggttgcatcttggtttgttcggcttatttcgagctatgttaattgcaagtcactactctctgagggtctctaagtgctctgagaaatatgaacagtaacagttcccagctattgtgagttgttgtgggggttgtacaaaagaacaagcataacataagaaaagcataagaatgagcctgagacactgtgagtactcagtatacattggtcatcataaccaggactgcaagtacagcaaggccaatgaagcacttcctttgggtgcaacatttaagagggtgataaatgactcatcagtcaagataagtaatattttaatatgatatttttacaaataaaaaccaatgcaaaaaaaatgatgcaaaacaaatcaaaatttaaataaagacaagatccgactgtacttgcccaaccttagtctcagccctgctggatcctctattattatgttaatcatggaattcttggcattaatttctattctctaaaatattgcactgaaatggtatttaccttgataacttaattgtttggcacccttttaaattttgcatccaaggagggattcttaatctcttcttccttgtcctggccctgatacgtggctttccaattttctacgatgagagtagttacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacataagagaagaaggtggggtttctgtgctagcaccagaagacacaaactggaggcagcaataccactgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccagtcactccccacacaccgtgcaccccagctccgctttcaccatgaagatgagcaggaaagaaaactcatctcccaacccgaggttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcacagtctggcatacagcagaggcacaataaatggaagatattgtcacaaggatagcaaggaggaaatgtttaatctgtaagcatttcaaagagggaagctaaaattgtatttctaagcagaaatttgtggacccattttaatgacaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatattatacacttgaaatttgtgaagcgattagatcttaattatactcacaccacatacacagacacccaaaatggtaaccaacagtcgtgaaagatgtgttaattaattcgatggtggtgatcatttcacagtctacacactcatcaaaacatcacattgtacaccttgaatacaaaccactttatttgtcagttaaacctcaataaagctggaaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtcccagctacttgagaggctcattgaaactctttgggctcagtttcttcatctggagaatgggaattctcatacctaacctacattatttttccattatttttccaagatgttcagaagtcaattgcataaaaaaccacctttcacaatgtagatgatcaataaatataaaagggagttctgcacgttattatttcaatacgaggtgggagtttagtgcagcaggctgcagctgtgtgtgcaataaatatagaattagaattttccacattgagtttctgaaaaactaaggagaacatgaactctggattcaagagagtcatactagctatacgatacaaggttaattgttctgattctcagctgcaaaatgaggataaataatcatggtgccacctatgatgttgtaaggacaagataaaagtaagtacatataaagcaccaagcatagtgcttggcccatgttaagagctcaataaaaagcattattttactataattatgatcatcattattatcattgctactcccctgccaggtttagcaggggtcctacctgtaccagctccaacataaagagccacaggacagtctggacagacaactgagatgctgtacgtcttggtcaggcccttgcacttctccagcctgtgcatgatgtcaccacttccccaaacttctccctctcacctccaagtttgtgctaaaccgcttaccaagcagcttcagactcattaacatctaatcagccctaattggctgcaattcagcagaagtcctttcagggggcaggtgactggcagaatccccagaagcaagcccacagcctttggagagcagtcactgggtgggtgggagagggaagaccacagctgggtcccctaagcagcctgtaccttcccagctctaaggcagccatgagacctaggtagtgaatgaatggactggtcaatgacggctctattcaacacatatttattgaacatctatgttgtgtcagactctgccctcctggaatccctcctggatggccctgtgaggggaatctactattgttcccattttatagcagaggaaaatgacgcccagaaaggtgaagggcttgcccaatatcccagcagctggtaagtgttggagccagaattctcacctcagcagtctaccgcagactccaagctcttcgccactcagtgaactgtgatacattcccccagttaccaatggtagactttgaaaaaggaaataaaaaaggaagctgaaatccacattgacagcaaagataggcaggaggggattgacaggagcggaagcaagccctttctcaggagatgatgcataatgatgagaaatagccagccaagggagggaatgaggggaagagcattccaggtggaaagaaaagcatatgcaaatgccccaaagcaggggagaccttggggttgtctcccctgtcaggggagacagggtcagtggggctggagcaaatgaggaggctgccaaagtcaatgtccatcaagcccgttcaggacactctgagtgaccttaggctgcattctgccccatctgcctaacttctcttctcagtggactctctgcccccagtgatggggatcatcatgctgtgttaccttgggcaagtcgcttcacctctctgagcctcagttttctcattagtaaaatgagagtaatggtcataatacctatctcataatacctcatacagaacaccttgctgttcctccatgtcccaccttgacacctctagaaatctcttccctctgtctagaatgtctttccctatccccttcacctgtggaggttttactgtgattatgaggcacacatcaaaataccacagcatccaacatatagcaggtgcttgataaatatgtgttgaataagtgaatacaaactccctagcagaatagaatgcaagccttgatttccagctcagccttacacacacatacacatgcatgcacagagtcacacacatgcatatgtgcatgcacatattcacacacacacgcacacacgcaagcacgcacatacgtgtaccatcccagccacacagaacatcttgctgttcctccatgtcccaccttgacatgtctacaaatctcttccttctgtctagaatgtcttccccatctccttcacctgtggaggtttagcctcgctttaaagtccagcactgatgctagtttcattttcctctacatccctacaacatttcataaacaaaaataaaacatacatcagtgctgcaccatagtctatttcccaccctctcttccctcacctcagactgagtgcttccccatagcaggtcttattcttctctccagtctgaacacttagcacacagttgacattttgaggatgataaataagtatttagtgactgaatgagtgaatgaataccttggaactgtttttccataaatatatattcccacagttctcttcctatcagtcaatgaacaaccacttaataagaccccgtttcttttgagtattatgccagctctttgggagaaaaatgccaacaatgacactgttctcaagaactgaaaatgtggtctaagaacggcaccactagaaagtactacacatgcataatcagtatgactaccacacctggtattccaatgtctaccagggataaactgctcagtttgtagattaacacaggaatctaaaggagaaaatcctactaatcagggggatatagcttaactttcttgcttaaacaacccgagatgatcagccagacttcccaagcctgtaaaaagagggctctaccaatgagaaattaaccacctggtattgagatggtagattccgactgagtccactcaggctgatcttagaccgagttggcaacaaacaaaaagagggccacagctgcccccaatgttcagctgcattcccaagctagagaacgagacacttccaaatctgaaataactcatccaactgaggcagggctctataaacaacagacaagtaaaatacattgaataaatattacataatctattttctttagtggttgtgtctgtatatatgtgggtacattcaggtgtggtttttacaatgacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggtgatgaaagaaatagatgtgaaggaattaaaacaccaaaaagagccttggtatttcctctcatcttggttcaataacctcttgtgagaaaaaagttttcagtgcgtgtcgctataaatgagcatgattggcttgccagttgaacctacaaacagaaataatgtgagaggtcacaagtccactcatttgcactggacttccaaagagttttgtcatgcagtgtctcagttaatcccccaatagcccagggaggtggacatgggcaccattttacatacagagaaaacatcccaaaacattgcagtgatgacacatatttattaagcataaaccttaggccaggtacatcacacattatgccatttaatccaccccataaactgtcattgtgcctcttgttcagaagaacaggttggggcttagagaggttaaatgactcatccgaggtcatatagcttgtcctcagagccagaattcgaatccaaagacatgttcttaagaaccatggcattcacctctccctaggacacacaagggctcaaatcgagcccatgaggcttctatcagctatctaccagttcatttggatttttggctcattgcagactaatgatgcacaagtggtctcattaatggtatgcatgtttgtttgtttgtttgtttgagacggagcctcgctctgtcacccaggctggagtgcagtggcaccatcttggctcactgcagcctccacctcctgggtcaagcaattcttctgcctcagcctcctgagtagctgggattacaggtgtgtgccaccacacccagctaattttatttttagtagagatggggtttcaccatgttagccaagctggtctcaaactcccaacctcatgatccacccgtcttggcctcccaaagtgctggaattacaggcgtgagccaacgtgcccagccaatgtcacgcacagttttaagcaaaactatgtttcagtctcagctaaactatgtcattaccacgtcttctctgtctcccattgccgcttagagatcacaagatatgccaagatgggtctggcttttagagactctcattttgcagacccattcaagccatggatttagtgtagtgtcaagatgagaagcctaaacaacatagagaaagcccacgttcagccataacttcccactcactcctcactgaagaggtaggcacaatagctttctcactgcttagcaattatatcaagtaagagctgttggatggcatgagagaccacaagtagacacagaatggctatttggttggctggctgctcattttttgagcaaataaaataagcactaaattcaaaacagagcctcccacaaaataatccaaaatttaaatgaattttttaaaaaaagcatagttgaaatggagataagtcatggaagagtcagagaggagagaaaagaagagggaagggaggaagagggaagagaggatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactatcatgcttataggaaactcgtggctctggggtttaacgaaaggttttatatttttaatttgccagatcagggacgcagcagggtcttttttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctgactattttttcttttttttggagggacagggtctccctgtgttccccaggctggtcttgaactcctaggcttaagtgatcctcctgcctcggcctccctaagtgctggaattataggcgtgaatcaccatgcctgacacagcagaacctttgagatatatttaagcaaggaggctggaataccacctcatttgactccagggaaaatataactttttcccagagatgaaaataaagacaccagagcggggtccactcaaggatactgatgtgagccatcccctgcctccctatatcggctggcagagacaggcaggctaggggatgcaaaatctcatgggtagagatgcagccttgcttcagagaaatcttactgcaaaccctggaggccagactttagacaggattgcaatgaccttatgtatccgaggcagtggaagtttcctctaaagaaaaaatgggaggcaagtggcttgaggaagtcaggcacagcgagcttcgtagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccactttgacacatgactgcttggagattgagagccaaattcaaatcccaacttaggttctcactaattggatgagttggggcaagtcacgtcaccttcctaagcctcagtttgctcctctgtataacaagagtaataaaaagtagcttcctcatggtattattgtgaaaaataaaataaaatgcttggtgcactgtccagcatgtacagggaatctattgctattatttattattgttactaacagcattagatgcatttcctttctctgcatcttgaaggtagtctatgcaaagtacccagcatagcctgtaggatatctccaggccattagagagagaaaaaagaaagtccttcctaaatttaaacttcatatcacttcgccctctgatttaagcagggcattaggttcatctctaactctccctttctgtcaactgaagaacatggatctgctccattcactgcacagtcaagctggggggcactgcagagaacaaggaaagaagaccaccaccagcagacatgggccatggcagctcttaacaatggccccaggaaagcctagtagctccactcagtgagaaacacgccaaacaagaaccaggtctgcttttctctcacttcctcccaccccaaaacaatgcagaacttgaaatcaggtgctttcagattcaggtgaacgaacctcaggaagaactgcacttccagtcccctctctttctcaatcacagaaacgatcaagttctctcctattccacctgcctgttctcaagtggaccctcccgtgaagatggctctatttcaaatcaaaaccccatcgcaccaccacccaagggcttccttttgcctttccctaatccactttttgcctagtgcttattatcagctgacacattaaatatttgttatgtttctgttggcctctcctcacacaaagaagacaggtttgttgactgctgtatctccagcatgcacagcccattgaaggctcaagtagcatttgttacatgagaaaataagttgtttatagccctccccaacacctagcatccacataaagtgtaagggatcttataaaggagttgcccatattacagatgaggaaactgaggctcagagagaacagacttttccaagctctcacagcaaagtttagcatctcagctatcaagacaacccaagtattaacgttagaatatagtgaatgtccccccctgccagtgctccaaggaacgttcatcctgccttgtttcagaagcaacatccacagccacagcgtcataggagcctggctgcccatcctgggtctgcatttactagctgagtgaggttggtgtgtctctcagtgattccatctagccatatgcaaaataagatgacaaatcctgctcttactaccttccagtgctgctctggacatcgatggaatattttggaaacatccttggcttctgatgatggaaggggaacccagtgagacatgaggagtcctcgctggtgagtgctggagttggtgagctttcagcatgggctggcctggtgcctctgcgacttcccatccacaagctgtccctacccttactcgtcacaagcaaggcaatgttgatgcagtaaaggactaaaccagagatgatgctgcacccaccaaccaagtgcttcctctgccctgcgtgctcctcctctctcctccctcgtccaaggcattccgaaaagcacccttgtcttttgggcagagttccctttccaccctcgagctgtccccactgccttagcctggactaatctctccagggaacctctcctacatccacctggcttctcacagaacagtgcgggaggttggggacttattacaaagtgctctgaaggatgttgccgagtgcctctggtttttgtctagtcactgaaaatgccgacatcatccttgatcagtgacacatgttctacatatgccccacgccaggtctgtgttgagcagtaaataatatgtcacttactgcttgcagcaactctatgaggcaggaactgtgattgtgcccatttcaaagacgagcaacctgggacacacagagtgttttgttaaattcccccaagtttcacagtcagtaagtggcacagccatgattcaaatgcaggtatctggcatagtagggaaagagcatggtggtgatggctacaggtccaaaatgaatgtgtgctcccatttacacagtgtggcactgtcgctgggaggcagctgcccagccatggacacttcccagcacctctgcatctgggtgtagccatgtgactcgttcatccaacaggatgtgggccagagttttggagagataggacaccctttcttctctccttcctgcttcctggattttctggctgcttgcagaaaatcctaagttattagaagatggcagagccacaagatagtggagactgacttcttaaatccccacatgaagagaagctgcctgctgaccccaggaatacccaccattggaccatcaggttagcaaaaagtaagctttattgttaagccagaggtcagcaaacttttctgtaaagagctagagagtaaatattttgagctttgcaggccatgcagtctctctcacaatggctcaactctgttatcatagcataaaagcttccttagatgatctgtaaacaaatgggtgtggctgtgttccaataaaactttattcacaaaaacaaacaagggcccaaattgggctggagaaccacagcttgtcaaatcttgtgctaaggcattaaaattttgcaggaattatttgttattatagctaatgttaatcaagtaatataggaaagggggagtcctctttggtttccttcttagtctcctaataatccacaaccaaatgcagagggatctcactttcccaactctctcatttctccccagagctggagtggccctctttctgtccccactgaatccatttatctatggaaaattgggagagagagtctacaagaagagcactatacctccccaccccaattgcacacacttttttttttttcttttcagacagagtttcgctcttgttgcccaggctggagtgcaatggcacaatcttggctcaccgcaacctccgccttccaggttcaagggattctcctgcctcagcctcccaagtagctggaattacaggcatgcaccacccacacgtggcaaatttttgtatttttagcagagagggtttctccatgttggtcaggctggcctcaaaccccttaggtcaggtgatcctcccgcctcggcctcccgaagtgctgggattagaggcgtaaaggctgcagtcacgtagactcaaaagaaaaacagtattttaaaaaaaagaacaagaatgctgtataaaacagtaaacagtaaaacataatgcagcaattaaaagttaatgccccaacatttattttggggatacggcatatgtctcacctagtctgggactaaaaagtttcctgccttattcatgcaggggcttcttcatggtttgcgtaaggcagccaattaaagtagaaactcagacctggcacaatgctcacgcctgtaatcccagcactttgggaggccgaagggggtgtagatcacctgaggtctggagttcgagaccagcctggccaacatggtaaaaccccgtctctactaaaaatacaaaaattagccaggtgtggtgctgcatgcctgtaatcccagctactcaggaggctgagacaggagaattgcttgaacccgggaggcagaggttgcagtgagctgagattgcactactgcactctagcctgggccacagagtgagactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttaaaaaaaaatcattaaatgttatacaactctcatttctctcgtccttcaatattactgcatttctctcatcattcaatattactgtcagttctggcagaaaatataatatacccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgcctgcacttactgttgccctgggggtgaagatgctacctgaaaacccacatatcctggaaaggtctcacacaaggatcaggcgttttcagacagaaaggttttcttgttgatgttttctactgcattctctcttaagctcaagactttttattttgtgttttttacattgatgagttataaaggggtctctctcatctttcccttctttttaccttcttctttgctgaatctctgctctctggccaggagtcattacatagaaacttaagtgcagggtgatcatctattaactcagcaaatagttatcgacagctacaatctcagatactatttaaggcttcagagatacagcagtgagcaaaattgctgtcaaagtgcccacattctagtggaaaaagcaataaatagatgtattatttgttgccctaaaaaagtgaaaagtgaagcttctttggtatgtctcatgcaccatctagggggtaggctctgccatactggctgctgacttgttaaaaatactactatcatgaggccagggagaaatctgaactcgggaaagtggtgtgggggccagaatttgagaagagaagaagcctacgctggaatcgcacttagttcacgtcacttcccagatctggcttccaatggcctcttctcaccctctaaataaaatacgtaaatcctcaatgtggcctttacaatctgcctcttttaatccttctctgcagccacaatgacttctatgatggtcttccaataccctgagcctgttcccacctcagggtctttgccattgctgtgctgccccctggaaagcccttcccccagatactcacatgggtgtcccttcacttcaaatgtcagcacaagaggtttttcctgcctaaatggcagccaatatgctctagtctctcgccctgcttttaagtatttcttcccagccacactgcttcctgccacattcattcacttgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaactgtaacttactgcctgcactcctctcccctgcagccagttctccacgtggccaccagaggatgcttctggaaggtaaatctcatgttcaccaccatccaccctggctttaaaatctttagtggtttctttctgctcttatagcaaagatgcaacacccaaatgtggcctgagggtctcagcacggttctgctctgacctccttcactcttaccctccaagcaccagggtcttctcaggcaatttttttcagaccagacatttgctatgatccctccggccacagggcctatgcccagtctctttccacttcctgcaatgcttttcccttccctctgtcacccaccctagtcttcacatctcagtttcagcccatgtcctcagggaaccttctctgaccttcctgggtgggtcacacagtacttattacagcgcatcgtatttacttgcatgatacttttttgaaatatgtccctccttctctagactgtcagattcacatgagcagaaacagcacctggttttggaccccattttatgctgagcctagcatatagtaggctttcaagaaatccatgaacaaataactaaagagctgtgaccttcaaacaagctacttcaagcttgttgagccttgggtaacgatggctatgccagagagacatgggagacttcaatgacataaaatggatgatattttataaacaacaattggcgcacactgtacaaattaagtgattttttttaaatgtgggtctacccacctctaagcctttcatctaatttgataccttccacagagataccttgatctaaatgccacctctgctgagtttcttttagcgccttttgcattatgaaaagtcagtatctcattgaatcttctcatcaaaacagccagacatttaccatgtgttccaagtgctttatataaattaactttcagcccttgcaacccaccttcaaaggtaaatactatcattatccccatttcacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttaaccaatggagagtttcttgtgtccatatatccagtgtccttacccagtggagagtttctcgaacccatgactacaccatgcttttaagcacaccaggctcctaggataccacaggtgccccagctggtttgcacctgtgggcaaagtttgccctgcattcctgggcacgtgattatacctatattggggtgaatttctgtgactttcccagatgcatgtatctgacacccccacctaccaaccgtgaactgttataattccatcaacatttgccaagcaagattgtaccacatggaactctgcagtgagcagaggttacagagtgaggctttggccaaataggtctgggttcaaatcattcattcattcattttgttaacaaacactgtagagctttggctgtatgatgggcctgtgttaccaactcaggataccaaggtaaacccaggaaacacaggtgccgctatcagaaacccagagcctggaggggtagacagacactaaacacaacaacaagcaagaaaattggcaattgtgatacaagctacgatgaaaataaacaggatgatgtgatgaaacaaaactgagagtgaggggttagaacagggccatgatcttctccccatcaagctaaatgtgtttgggcaagtctcgtaatccctccaaacctgtttccaaatctgttcatggtgatggttaatctcaaggcacatataaaatgctcagaaatgaaagctatgcctttctggaacccaggcaccaggcattcaggtgtgaacaaagctatccatgcagtccgggaggggagccagagagaagcaagcatgtgcgaccagcattaaaggggcagctgcagtcagtcctctctggagccctgtccttgttcttcccaacacagccttgtgcgtatgctgatgctgcatgaaatccctgcttcttcatcgttcgtcacaagaggtaagttccccagctccatcccagcccagcagccaaccataggaaaggcagctgagaagtgccttccttctcctgccttcttgggtcattgagcaaagaggagacagaggcacacgggcccactctctcttctttttttcctatcaaccgggccaaacaaccagcaaggaacacctgctgaaaggtgaagaggacagagccttggcagagattaatgccttcctgatgccaggcggccgtgagaactgagattggcagtgtgaaggtccaccttctctgcaaccaaatcataagtgtcccatagacaaaggctttgtgtttatctgccttcagactggtcagtgatcagggaagcttagcaacttggggcaaaactggctcagggccgggcatggtggctcatgcctgtaatcctagcacttcgggaggctgaggaaggctgatcacttgagaccagaagtgcgagaccatcttggccaatatggtgaaaccctatctctactaaaaatccaaaaaattagccggaatgttagcacatgcctatagtccctgctactcgggaggctgaggcaggagaagtgcttgaacccaggaggcggaggttgcagtgagccaagatcgtgtcactgcaccccaggctggacgataagagtgagaccccacgtcaaaaaaaagcaaaaaaaaaaaaaaaaaaaaaaaaaaaaactggctcagaactgatggagccacactttgagaaggatgttgacttgctggctaatgaatgattaaggtcaagaggtaaaggtgtcactcatctttaatagtcccaggtggaagaaaactggtctatctattcaggagacttactggtccttggctttcttaaagattccccaaatctagagttctcctgacattggtgtgacccctccactcatctcaagaaccactaggactttgcattttcagaaagcatggttgactgtctgcattcagtgatttgttggctgagacagtcctaataggtcagctaatttgaatatcacacatatacccaaattacacattgatactttagcctacagtaatctttctaaaactcttcagcggcccccattaaatataaactcatcctggctcacaaatcctttacaacatgacaacatctttgacttcatcttcactttcttttaacgtgtttagagacagggtctcgttctgtcacccaggctggagtgcagtggcaccatcacaactcactacagccttgaactcttgggctccagtgaacctcctgcctcaacctcttgagtagctgggactacaggcacacgtcaccacacctggctaatttttgtattttttgtagagacagggtcttgctatattgctcactctggtcttaaatgtcaagactcaagtgatcctcctgccttggcctctcaaaatgctgagattacagatgtgagccaccactccccacccatcctcactgcccaccatgtgtctgtacttcctttctctcaccctcctctccatataccctccaaactgtactgctcctctgaagaagtctcacacatctatatctccctgcctctgctccatttcaaatgtccttccctggctcctttcaaagcccttacctatccctcaaggcacatctcatgtgtcacctcccctgtgaagctctgcctgacttctccagggtctcacagaccctaggccaggggctttcaaacttgagtgtgcatgggcatcacccactggagtcaccgaccaggagatctcaggggaagcccaagaatctgcattcccaagtgatgctgatgctgctggtccagggaccacactttgagaaccactgcactggatgatcgatttttttttttttttttttgagatagggtctcactctgtcacccaggctggagtgcagtggtatgatcttggctcactgcaaactctgcctcctgggttcaagcaattctcatacctcagccttcccagtagctaggactacaggtgcttgccaccatgcctggctaatttttgtatttttagcagagacggggtttcaccatgttggccaggctggtctcgaactcctgacctcaagtgatccgcctgcctgggcctcccaaagtggtgggattacaggcgtaagccaccatgcccagcacgattaatggatttctatggaatttaatttcctttctgcctactgctttcaggtaaaaacgatgaatgattcagattcccctgatgatctcacttgcataactgagatcaggggtttttctgaaattcaccaggacttctccccttttcaatcactttgtgtgattggtattagcattagttctctagaactgctgtggcaaagtactgcaaacttggtggcttgaacaatataatttttttctctcatagttctggaggctgaaagtgtaagatcaaggtgtcggtggttccctctggagtctctgaaggacaatctatttcatgcctttcttccagcttctggtagcctcaggcattccttggctcatagatggtgttctatttatgccataataaaaatattagtacttactttttttttttctttttttttttttttttttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccacctcggcctcccaaaatgctgggactacaggcgtgagccaccgtgcctggccagtattattttttttaagattgtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgttttggtgggggatacagcccatgatgccttgtcagatgacacctctgatcccaggaggatccatgccgtggagacaaacaactcattatttgccttgatgacctgtcatctcatagacacctccctggatggatggagcactggaatttgggctaccagagagttccgcctcggttagcagaagtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtataactgcattccattgcactgcattaactaaaccaattctaagttcttttgtggaaacatggtgatcacttctccgcttgcatgcactaacagcccgcatttgaagcctctccccgccgtgtgcagccctgccaccctccaccgcacccgacatgcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcagcggagtgatcagagttcactgcagcctctacctcctggactcaggtgatcctcccacctcagcctcctgagtatctgagacaggcgcatgccaccacacccagctaatttttgtattacagtgacagggtcttgctatgttgcccaggctactctccaactcctggattcaagcaatcctcttgtctcagcctcccaaattgttgagattacaggcatgaatcattgtgcctggctctactcccatttctaagccctctcccacacccagcagtccttccagacaaacccagctgtctgcagctcctcccagtctacatcataatcccctggaatgcttttctgccttagtctgttcaggctgctgtaacaaaacacataaactgcgcgtaaaaacaacagactttatttctctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttcttaaccccagcactgcgaacatttggggctggataactctgcattggagggggctgtcctgcacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaaaaattacccgggcatggcagcaggcgcctgtagtctcagctactagggtggctgaggcaggacaatcacgtgaacccaggaggcggagcttgcagtgagccgagatcgcgccactgcactccagcctgggcgacagaatgagactccttctcaaaaaaaaaacaaaaaacaaaacaaaacaaaaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgcccggcagggagcagacatcccctcccaccccccaatgtccccactgatgtctgttgatcaactagatgatagacagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctatccccagggtctcaggtaaatgtggctttgtttaaaagcgcattctctggatcttctgttttcatttttaaactgtaaaagatagagttgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtccgcacccgggagcgggggcggctgctcgctctactcctgggaggggcctttcgaaggaccaggtgctgggcagaagccccctccctccctcagcaatgaggagcctgagcaaatgtgcaagggagggagagggagggggagggggagggggagggggaggggggggagaaagagagagagagagagagagaggagtcctggtccacaccgctcagaggaggggtgcggcagccacacactcaccaggtacacactcgcaatccagcacactcacagcgcacatgcaaacacacacaacccacaaacagcacaacccacaaaaacacacaatacacctccacactgcacaaatacacaacacacacatccacacaccacacacaaatatactacacacatccacacaccaccataaatacactacacacatccacacaccacacacacaaatacactacacacatccacaccgcacacactacacacattcacaccacacatacacactcgcaacttcactcagtgcacatgcatacgcccacaaatacaccgaacacacacatccacatcatgcaaatacactacacacacattcacaccacacacacatccacaccacacacacagatacataaacacatccacgtcatgcacatccaaatacacaacacacatccacaccacacaaacatgcactcacaaccctggactcacaatgtacaaacacacaacacatacatccacaccacaaatacacccacaaacacaccaccacacacactcacaaatacatgaacacagtcacaaatataaatccacgccacacacaaatacatgaacacacattcacaccacacatccacaccacaaacacacatccacaccacataatgctgcacactcacagcagacatacaaacccacatattcacacacacacacacacaaaacacacatccacaccacattcacaactacgcacacataaatacacatagcatacacacacaaatacacacacactcacatgtgcacacacaaacctacacattcacaccacacatacacacaccataggcacactgcacacactcccatggagacacacccacgcaaccctcacgcagctgcgctccgacactgcatctgcctctgttcctgaataagccgctctggaggctggaggcagctgtgggggaggctggcaggtcagagctgtgccgatgagccgtcgtatctatgctctgcgaaagcggccccagccaggaacactcccctctgccgcaggctggaagaggtggctttctctgtgcttatcctaagcccttccttctctgcctccacctgacatcaaagccccctggcaaagtaacccaggttaaggcaccccctcacctccaatacacaggtggtggtctgagtgggtagagtgccagatgttaatcagcagcaattaatgtctttttactttaatgaatcttatcacctttatcataaaaaagtgaagggaatgtgtaagacttcacttcttccatgagaccttcccattttcgtaagctcatttttaccagctaattcttccaacaacccagcctacaaaaggtataacgcagagtaggaattccagggggaaagatgtgcaaagtaaatcttaataaattttgaatcatattttcaatgtattgggtggggtgtgggcttgataattaaggagaatcttctgtaaaggttcaataaaatgacaaattcttttgtaaagagattactcattctgctgtacctactccctgaagctaaattgttatataaaagccttactttgaacaagctagggaagttccttaaggcaaggtggtgtcccctcagttctttaaaacacaagtatctcttaggtaagggctctgagtggggcctcttcctagctacatggtctcacggggtcatttaatgtctccgggcttgtttcttcatctgtaaaatgggagtaatattgcctgtctcccagggatgcaataagagttaaagataatatatgttcagtgtctggtacagactaggtgctcaataattgctagctgataactttggtatgaccatgcttttgaccaacccagatacccatccttgagtgtataaatccaacctactccgctgagctcagttcaaagcccaccttctcagtgaagtctttccatgaatatgctaattggaagtaaaccacctccttctgcaatctgcagtcaccccctggtactttatttgttcctttccacattcagctttgtatatcgcaatatagtcccggtgcatcttacactccctttacaccataattagcaagactcatgtctgagtcctccttgtgcaatgattgcacacagtaggggctccataaatgttccttaggtgattaatagcaatagtgtggtagaccttgtaggtggctccaaaaaaagcactccaccccctgaccaccagataacaatggaatttctgttgtaccacacataaggtagttttaaaatatgtctgcaaatttttcaatactcccctccttcaaaaggtaaagcttaatcctccctgtgtgcttggcaactctcttctcatgaatggagtgggggacaaaagacagtgtgatttctgagatgacatcaacaaaggcaatgtggttgccttctctcttttggatcactcactctgaggaagttggctgccatgacatgagggacttcaagcagccccacggagaggttctcaaaatcaataaatgaggccccctgccagcagcctcggaaacaagccatccatgccagccagtcctccagcctcagtccagcctttagatcactgcacctctggccaatgtactgaccacagcctcacaagagaccctaggcaagaatcccccaactaagttgctcccgaatatgatccacataatcagtaagataataaatgcttgttgcttcaaacttctaagttttgggatgatttgttatgcaccaatagctaactaatacacaacacagccatcagtacatagttctgatgctgacccaatcccggacaatgatatattaagaggaatctgctggggttgggatggaggcggcatggggaaacatttactaactcacacctaagggggccataggaagataaaatctctcttctgccacatttgtgtctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacgtcagagtttctggtcatgtgaaataataagtttatacatcgtataatctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaagtaacttttcctaggtcacatagctagtgagaggcaccgctaggattcagtacaggcctttgaactcaaagttgacattcgttccaacccaccaggctgatgatcaaagtggcacgctaagaaagcaccccaggatttgctcagaaaggcagccgggatcacatcagcagcaagcccaaactttaaatgctcactcgctacctccttatctttttgtggagctaaacattatcctctgccatgatgccttccaaagcaggacaggtcttgatgtgattttccacttctcactatatatggtattgtttctcagtatcctacaaagatgccaccaactttcaattatctcagctagggaagcttctgcaaccattctagcccacagtcaaggctccctgctctgaacccccactgtactgataaccagaaccacacagcttagtgctgaagggttttcaaattgtttcaagcatcttaacctgcccccatcagccaagctacctccttcttaaggtcaaactcctgtgccaaatactccttttgttcagcccctgagcctagatattacagcatttgatgcttaatatacacttgcccactgcttgatcaatggaagggggctgcaatatacatatacatacacacacatatatatatacacacatatatatacacgtataaatatgtgtgtatatatacacacatatatatgtatatatatacacacacacatatatatatacacatacgtgtgtgtgtgtgtgtgtatatatatatatatagagagagagagagagagagagagacagagacagagacagagacagagacagagagtgcctcactctgtagcccaggcaggaatacggtggcgcaatctcggctcactgcaacctctgcctcccaggtcccggttcaagcaattctcccgcctccgtctcgccaccatgcccagctaatttttgtatttttagtaaatatggggtttcacaatgttggccaggctggtcttgaagtcctgacctcgtgatccacccacctcggcctcccaaagtgctgggattacgggtgtgagccaccacacctggcctgcaatattttttcacacccggcctacaatatcatttttaaaatcatgtgtacatggctttttgctgcacagaaaagtttgacttgcctgccctcctttatgctttttctttcctctgttgatgtctttgctgagtccttatgaagtctttcctaatgccactccctaactcccaaattaagtcattcttcatctaggctgtcattgtgttctatacatatctttaatatacatcctattgctttatgattatttgcttttgaaaagtttttagacaatcagatgtgttaaaaattccctaagcaccaatgtctggttcatactagatgctcaataaatgttatgaaagggatgcacacgtttatcattcaaaggatagcctacgtctgctgtgttcctacaacagttatgacagctctcatcccacgacattccaatcatgtgttcgaatctgattcctcttttagactgtaagttaccaagggcaagaaattgattttttcaccattcttatctctaacataaatcacagggtacaaggcgagcattcaaatatttgtagataaatgtgtgacaactgtgatctatttagtcaagggttaaatgtgttactattccctaatcaatgaccagggaattattgagcaattcaaagacactgcttttgaataaaacatttaccgtacattatcacctggcaaagaaaaaaaacctgtgcctgttcaaaatattcttttgaaaatgtttgatggggaggatctttagttgatgtcataggcttcttcaagttggtgacagttccttgccaattggccgaagtcttccttggtgccttccatcaccagggtgcagacatgattcaaggatttctggtaagatctggccaggaaaatgtatcccacgagctcaaaactgccaagcactattgttaataacacagatggcctccttcaggaaagtattattttctttccctaaatagaagcaaggtaaatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagttaatcctgactgatcttctgccagaggtgacaacctatcctcggggtttggcagtgagcctgatgaagataagaaatgccagactgggtcagaccaatggcccattctggccatggcactgtctgacagaggcatccagaaacgttttgcagaaaagagctgtatttgtctcctatgacatcagtcatcaaaaatgtgcaaagtcctcctgaagcagatcatcttggggtgccccacccaacttccatgccacccttttccaagctgatggagtcctcattttgttcaagtgcttacttgcctacaggaggctcaggattaaatctcttttgccctatgccagggtttctcaacctctgcactactgaccagatcgtgtttctttgctgggtgggctgtcctgtacattgtaagatattttacagcatccctggtccctacatgctgatattagtagcatctcccgacaaacacctacctgtgaacaccaaaaatatcgccagactattacccttcggggagggaaagacaaaattgtccccagttgaaaaccactgctctaagccaatatgatagccccattgccttagccagtgatggttttaggggtgagcacgtgatccagttctgaccaatgtggcatgagaggaagtcatattgaggccttttgagaaatgttctctcactcttaagaagctacaaaactgaaagtgtctctttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacggcataaatttgagttggggttttgttacttgcagccaaaagcatcccaatataaacaccttcccatcttttccataacaaacctactttgcttctctcgcttattagtagtcaaaacatcacctttcaatgcatcccaatgccgtataggatggtttaaagagccctggagtctgaggcaaacagctaagtttgagcagcagctacacacacacacacagctcttaatttccttcatttcttccatgttgataacaccataaattctgcacccttttgagattgtgtaatggtcaaatgagatagtgtgtatgaaaatgcataataaactccaagtgctttgtgggtatcattacattttcagtccctaccacccccttcagagggtggcacgtctacatattcaccacccaacactcagacttcagctaacgtttattaagcctaactatatgttaagtgctgtgtatatcagttgctctaccttagtgctgttgacagttggagctggttaattctgtgtggaaggaagctgttctgtgcactgtaggatgtgtagaagcacccctggactctaccctccagatgccagtagtactcaccttcactcatgacaaccaaagctgtctccacacattgccaaacagagaacatttgtccctgaaggataaaattacttcacattgaaaaccattggtgtacaccctggtgacatacagataaaaagatttgtttcctgccctcaagtaatttatatccttctataaatgatcatttattttataacataaaacaaccacaaccattatttggtagcagatagatctaggtcccactctccgctagcttgtggatgttactgtctcgatctcagtttcttcatccagaaaatcggggtgataaagtctacctctctagatcattttcagaattcagtaaaataaggactgcaaaacacctaacaaagtgcctggcaaacaattagtacccaataaatgttagctttgcatactattgtgttcttggtttaaagattattgtctgcttttaggaattaggacctcagttcctgttaatcttctttactttgttctatgaacttacagacttgagtcccatacctgatatagatgttggtgctccacctgaactgcctcagatcttcttaccatttctgcaaagccaccctgaatcccaatagccagcaccttcatctttgtaggagagaaacccctctgaatattggaccccacattgccagcatgcatggtgggtcagaagtgtctgagagttaatatatccttttctgccctggaatagcctttgaaagatgactaatgggcacaggagtataaatacctcagctcctccactccttggcaggaataattctcaggtgtgcattttacattgatctcagagcttacctgcagggttaactttcagttcaccaccttggtatctggcttactaacatatgtctcactggtgggctccctctccttttatcacctcctgtctcccctgcctgtgacccccctacatgtcccagataaactaggtacattcaatatttaatcacaatctgtttctgagggacccaactaaaacactatccctttactttaatgattaagagttcagactcaatagttatatttcctgattagaatcccttttcaaacatgtattaattttgtagccatgggcaagttatttcacctatgactcagttttctttatgtaaaatgcagataataatactcacttcacaaggttattataagggctaaatgagttaatatttgtctaatacttaaaatcgtgattggcacttagtaagccctatgtaagcaattattccttttaattccttcgtaatcaatcctagtctccttggcagccagagtcaagtttctaggacttgggagaactgcctactacctcaagccaacatatcaggaattatttaagaatctaattttcaaaaacagtcaacagcaaaaagaaaacttctatttgcccaaaggataattccagactttgttagtgaagacatatgtggggacatgttgcctgcaaactgcttggattcctccacttgaattaacattcaggaaatatgcctgaataagtctgcatttgctcaataatctctcctggcctgggaagaagactagagatattagtgtctccaaacactaacatagcccaggtctgtgccctccagaaatgagcattcctcgggctgttgaatggctaagcagtattccattctgaaagacagtaataccccacacttggcctcccttgggctggtgccacaggggctcaaaatgtctcaacccataaaagacttctctccccatttcctctctccatctcaaccttggagggtttctgttcctaatgctattctacatggcagctgggatcagtgcaagctccagggccaagttctacaagcctccttcctgctgacgtggaggaaggagccgagggagagatctctctggccccagcccctgcccattcatgcatcagaaacttgctgtctctattctaagctatttacctcccagtcgttgctattccaaaagagagccagaggggaggaaaatctataacagtattttaatttcctgatatgacacactccatactgaaattacccttccaaagatcagagttccgcttggcaaaagcccagtgaatttcaatgaatgataccacccagaaagaacagagttttgttttatggatggtgagatgacaatgaagagatggattgcctatttatttaaatttatttttaatttacatttaaatgctctgtgtttactctatctcaggcactgtgctaagcattttagactcattatctcaaatgctaccttctcaagttgtcacagcattaccaccttatttattgattttttactatttttttttttcgagacagagtcttgctctgttgaccaggttggagtgcagtggtgcgatctcggctcactgtaacctccgcctcccaggttcaagcgattctcctgcctcagcctcctgagtagctggggttacaagcacccacaactacgcccacctaattttttgtatttttagtagagacagggtttcaccatgttgcccaggctggtctcgaactcctgacatcaggtgatccacccgccttggcctcccaaagtgctgggattacaggcatgagtcaccgcgaccagcccacaacttgcctgggactccgcagtcctcttccctcctgatttttttccattatacttagcaccctccaatacattatataatgaattgtttgtctgtctctcctgattaagatggaagctctataatggcagaacattttgtgcaatttttttgtgagcagtgcccagctcataggaagctttcaattaatatttgctgactgaaaggatgaataaatgaatctcctggaatctttctgataacccagtggaaaagccactgttatcatcactcccatatttatactcatacccataccatcctacctgataggaagaataaaggtctcccaatagatgtctatgtcccgataccaagaacctgtgaatatgttaacttacatggccgagaagacttcacagaagtgattgaggatcttgatatggggagattatcctgaagtccctggtttggcccaatgtaatcagaagtattcttctaagagggaggtagaaagggcagagggagacaaggacttgaagatgctacacttctagccttgaagatgaaggaagaagccaggagccaaggaacaaatacaggtgacctctggagtagggatccccaaaccccaagccacggaccagtaccagtccatgacctattaggaactgggccacacagcaggaggtgagcggcaggtgagcaagtgaagctttatctgtatttatagctgctccccattgcttgcattaccacctgagctccacctcctgtcagataagtggcagcattagaatctcataggagcaccaaccctattgtgaactgcacatacgagggatctagatggcatgctccttatgagaatctaatgcctgttgatctatcactacctcccatcaaccccagatgggaccatctagttgcaggaaaacaagttcagggctcccactgattctacattatgatgagttgtatcattatttcattatatattataatgtaataatagaaataaagtacacaataaatggaatgcacttgaatcattccaaaaccatcagcccaaccccggtctgtggaaaaactgtcttccacgaaactggtccctggtgccaaaaagattgaggaccactgctgtagagacagtgaatcataatctgagagtttacagaggagcacagccctgctttcacaaaccttgattttaacccagtgaaacccattttggacttcagtcctccaaaacatataatttatataataaatatgtgccactttaagctaagaagttcatggtaatttgttatggcagcaataggaaagtaagagacccattattcagatgatgaagctaagactcgagagcatgtcccaggccccccatgtagttaggtggtaggatgatgtagatgtaagtgcagtcagcttaactccacactcttcctcttgtcctctgtacaaagtcaagggagttgatcaaacaataagaaacactgtgtgcaacactcagttcctgggattttggtgctataaggtcatgactattccaccctgcaatctcttcagcacccactctgtactttgggactgtttttcctctccatggaattctaagctcaaataactgcagtcagttgtaaaagtgcacagacaggaacaagacacctcctgcatgggtctcagagtctgatggaaagggcagtcgtaagtgagtagtaataaaacattgggaagaaaaactccatgggtgcagggcattgccttttcacaggagtatccccagagccaagatcaatggctgactcatagtaggcacttaataaatatttgttgagtgaatgaatgagtagtaactcaaagtagtttttaaagtgctccaagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagcatgccagggtgagtgcaatactgtgcaggtggtacagaagatggggcagagagactggccagaccctgccttctctgccaggctggcctgctcctgtcagccacaggagccagctcagacatttaagcagaagggtaatgggattaggtaggtattttgtaaagactacacttgcactgttacgtgggcaccataacaatgcattttcatttgtcagatcactgtcacatactaaaaagtcttgtttgtgctgagagatctcaaactacctcttttactgaagacttcaagggggaaactacagaattataatggcctggaaggaaatgtctctgaaagacaaggatagtggccagtagacaatggcacacatgcccaaaacattgtcatcaggaaattcaagaggtcattaaattctactgtaggaggaaattaacacaaagatgatcccaatgacagatgtattctcatgataattcaagctcttctccatctggaataagagaaaaacaaatgactttccaaagagctgatcacatttaatcttcctttaaagacctgtgggttggatgtgctatcatcacttcacagttaaggagactgagccccgtgggccagttttgcagagctggtgtttgaacttgggcagctacaaagcctgtgctccttcccatgctcaccctaagtccttttacatatcatgcactgaacttccaacaggaacggtcaagtccccaagacctaggccctgtccttaaggaatcgccatctgccccaggggacatgaatgatgcttctagccagggagaggggtgggctaagatattccgccttcaggttgctgggagggtaagtgtgaccagggctggctggcggtaaagacctcccggaaaatgtaggtcctgtgctggatataaagaaaagatctgttgaggcaggaagcttcaatcactagagcaaattccacccaaactgggagcttctcctaaatggagatcctgagccctatccttagaatacagagagtgaggccaggcatggtggcttacacctgtaatcccagcactttggaaggccaaggtgggcagatcacctgagatcaagagttcgagtccagcctggccaacatggtgaaacctcatctctactaaaaatacaacaattacccaggcacagtggcacactcctgtagtcccaggtactctggaggctgaggcaggagaatggcttgatcctgggagacagaggttgcagtgagcagagatcacgccattgcactccagcctgggcaacagagcaagactccatctcaaaaaaaaaaaaaaaatacagacagtgagtctgagtaaaacttgggaatctgaactttgaacaagccccactagtaattctgccactgttcagggccacaacagtgaatggagaagagtaggatggagacagaaagcttttaactgaaactttccaaattcagcaagaaaatcaaatgactgagacagaagatttctgtagttgactagcagaggatcctatggaaaaggtggtttgatctacaggaccttaaatgtcaggctaaaaggaagataatatattttgttgaacatctaccacagatcagaatctaatcttgtctattcttcacaacaaccctctatgaatattcccactttaaattacccaaagtcagccagctagcaagagaagagctggagcttaaacctgaaatgtgtgcctctctgaagcccataattattccactacacaccgtctctcttaaggactgtgagtgacgaatgaagcagagtcactggtatcttttgagcaggtggtgacaagttcataggagttttaggagggcaaatgttgcactaaggtggattgccctggggagaaaatggagccaggattagaccactttgcctagtctacatcctgccacctgctgttacaacgtccttctgttgtcagggtcactcatgaaatgcagtaaaagagctgtattagttggtgcaaaagtaatcgtggtttgtaatggcaagaaccgcaaatacttttgcaccaatctaatacatccataaatggatatatttgaatatggaatgacaataagaagttaaaatttaattttaaaaaactgaacagaataaagaaacaaagccaaagaaaggaaaagatcctacgtggataaagcagaaacctccacacaagagctgtattattagttggtgcaaaagtaatcgtggtttgtaatggcaaggaccacaaatacttttgcaccaatctaatacatccataaatggatatatttgaatatggagtgacaataagaagttaaaatttaattttaaaaaaccgaacagaataaagaaacaaagctaaaaaaaggaaaatatcctacgtggataaagcagaaaccaaaagtaaaccaagcgaaaaaaaagaagccaaataaaactataagctgatcttcagaggaaaaacattaaatgaatcttctgacatgactgttcaagaaaaacaaaccaaagaaaagaaaacccaaatggccaataaatgtgaaaatatgttcaacttcttaataagataaatgcaaattgaagaccatggttagattccgttttacatctatcatataagcaaaaatgaacaggactaatacaaagatttaaagagatataagaaggttgcaacttttcattccttgctgtgggaacataaacaggctcaatccttttgcagaacaaattggcaatctctggtgatgttgaagatgcccacatcctatgacccagaaattttacttacaggcatatatcattaagaaaatttctcatctgtgcaaagatgttctgtgtttcgttgatttaatgacaaagtgcccatcattcagttcatggataagtaaaatttttatacatccatagggtggatatttaaaatataaatagttaaaataaatccactaaagctacatttataaacacagataaatctcaataacataatactgagtaaaaaagagtaatttgggccaggcgcagtggcttacgcctgtaagcctaccattttgggaggccgaggtgggcggatcatgaggtcaggagatcaagaccatcctggctaatatggtaaaaccccatctctactaagaacacaaaaaattagccggacatggtggcacgcgtctgtagtcccaactactcaggaagctggaggcaggagaatcgcttgaacccaggaggcggaggttgcagtgagctgagatcacgccattgcactccagcccaggcaacagagcgagactctatctcaaaaaaaaaaaaaaaaaaaaaaaaaaaaaaaaaaaaaagaaaaaagaaagaaagaaagaaaaaagaaaaaaaaaacagtagttggaaaaatatagtactgtttataaaaagcataaaacatactaataccattataccctaggtttgcatgtacatatagaaaaacacatttatcagctttaggttagtggtttcctctgaggaaggagataagggaatgaaatgagggtggcaggcttcagcagcatctttatatttttaaaatctgaaataaatgtgacaaaaatattaacatttgttaaatctgaattgtcagtacatggttgtttgttattttattctctgtacttatcagcatgtctgaaatattccaccattgataaatcctggttttgaaagagaaaaagaaaagatttaaacacaataataggatgacttctctgagactccttagttcactgcagatatccagatcaatgtaaaaaggatactctgagcagacaaaacatctgggaagacctttgtcacatctgatgaagtgaatccatctggcaccaagctgcaaactccctattaacagtgcactggcaaactcagtcacttcaatagacaacatcagaataggtgcttttaaattcaactaagcccttccttaggcaaataagataaaagcttcaacagaaaccaatgtagcccaaatttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctaaacagcaggaattatacccaacatttaagttctttctcagggtttcactaagcatactccaggctagagacagctccaggctggatattgcaccaaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccacccttgatccattcaaccctacatctttccactcatccattcaaataatcattcacccttctctttatacaacaactcctttaccaatccatcctcttccccttccagccaggctggtcctcccttcccattctacacctacccattaagccaccttccattgcttcatacatccatctcttcaaccctctaaccacctgtattgggttgagcagcatccttcaaaaattcatgctcactcagaacctaataatatgaccatatttgaaaagaaggcctttgtagatgttatcaactaaattaatatgaggtcatactgaatttggaccccagtccaatgactggtgtcctgaagaggagaaaacacaggaacacacacaaggagaaggccacataaatatggaaacagagactagaatgatgtacctacaagccaaagaacgccaagggttgatggcaaccaccagaagttagaagatgcaggggagggtcttcccttagcatccttggaaagagaacagtaatgccagaaccttgattttgaacatctagcctctagaactgtgatataataaattcctgtggttttgagccacgaagtttgcaggactttgttgagcagccctaggaaactaatacaccacctcccctaccaactactccatctctccaacccccagccagtaatcttctcaactatacaaccctccacccctccagccttctacccatccatccctccacccatccatccagccatccacccaattccccattcattccatccaaccatgcatccatctatccacccatccatccatcattcatccattcacacatactttatttagggtctatgtgccaagtgttgttctgtgtgctaagtgtacaatggcgacaacagtagtagcacgatattatgggttcttcctctgacatatgctaataaccccactaatatcaccagacctcaagaataaatacaatctaagtaaatacaatgggcttgctatgcaaactgaacttcaaggtaagttccctaggtattcctgccacttgtaactatgttggtggcacttaggcccttccaatataaatgttctggggcctccactagatgaggagcaaaatatccaaggcctcttcccaaatggatatatagacaataaataaatcatacaagtaaatatatatttatcaattttgttgaattctatgaaggaaaaaaatacagctctacaaagaaaataacaagggtgcaggggacagggcactaattatgattagggagtaacagaaagcctctgtaaggtggaaaaacaaaacaaactcataagtagttaaaaaaaaaaaatcacttcccaaagaggcttacacgatcagggaagtattgggctttgggtaagtgctacacactctcagaggacagggagtccactgaagactgcaaagctttcttgaagaaaagtctgcctggatactgaaggataaatgacagttaagtaatgggagggatacctatttttagcgtggtcctcaataaacaaaagcgcagacatcactcgttcattttaagagatcttgacttttatgtgccaacgaccactttggcaggctggtgaagccttcaaattccttctcagaacagagctgtcaaataagtaaaataaaatacgtggccgggtgtggtggctcatgcctgtaatcccaacactctgggaagccaaggagggtggatcactcgaggtcaggagtttgagacaagcctgaccaacgtgttgaaaccctgtctctactaaaaatacaaaaatcagctgggcgtggtggtgcagacctgtaattctagttacttgggaggctgaggcgggagaattgcttgaacccgggaggcagaggttgcagtgagccatgatcaagccttgcactccagcctggtgaaaagagctagacactgtctcaaaaaaaaccaaaaaacaaaaaaaccaaaaaacaaaaaaacaaaaaacaaaaaacaaagaaacaaaaaaaccgctagattacaaagaaaacaaattatatcaaaatacagtcataatgatgttttaaaacaaacttgtgttatgtttatgtcggtattaacatgctaaatcacaagatctgtgctgtgtctactaactacaatgatttcaaaataatttggcaaaagtaaataattctgaaatatctacaacaatgataatgtgataagaaatatgtaatttctcttggtgaaaaaaaatcagacagctgctattactgtgatttcttgctacaattcaaaatgaaaagaatgaaaacttttgttagaggtaagtaaaaataagcaatttttccccatccaagtttacagaccactgagttccatccacagaccccttaggggcccgtttatgtgatttatatgtttaggtatttatgtatttgtccattcatttactcgctcattcatcccccaaattctgaatgtttctgacattcctgacaatatggttagtgctagcaatatacaaggccaaaaagacagatgtggtgtcttccctaatgagcttatattctagtgggcagagacagtcaataagcagataaacaagatagttataggctgtgataacaatagattgtgaaaaagaatcaacagagtgatatggggaaaggggaggttcacctggtgttggtacccatgatgaacacattatgcagcaggatggggaatcataatacatggaagagggattcagacaaaggccctgtaacaggagaagaacttgggcatcagaagaacaggaggacagtccatgttgctggagtgaacatagcaataggagacagaggaaatggcgacaaagatggagcagctgcagatgtgctgggccccacagactatgggaataggttttagttgtgccttaagtgcagtgggtagccatggaagcagtgtatgcaggggaataacagatctacattatattgttttaaaagatttctttggacactgaatagagaatggattgtaaagaaaaagataattgatagaagagaccagtttagaggccattgcattcatccaagtaagagagtggtgacttgatccagggctggggctactgaggcatctacgggtacagaattcaaggaagaactcattctcagggccatgcaagtgcaggattcagctacccctggctttgactggtggtagaaatgggtaggttgatgatatattttggaggtaaaatcaaatttgttctaaaaatttctgaagttcagaagcaaataataactttagaaaggagcccatgcctcagacaacagagcgtcttaaacaacagaggaaggacttttgactttctcctgtagctaatgaagggccatggaactaaagaaataaaatcacaccatcgtgaccgaaaaaaaaaaaaaaaaacaaacaagatttttagagggtggtgagaggtaagaggtaagtgaagagaatgtttgggcattatgtgtttatacaattttagattcgtgaatgagttaagacccagtcagggaaacggaaaccactccaggtgtttccaacagagataatacaggaaattggttacataggagccactgggacacagagagaaaaggaaaagaggaagccattaatatcctagggatggaggaaaagggggatgcaggagacattaccaaagttcagaagctgggtcgcttggcagtagcaaatcccacagcagggaccacctgataggaattgggaccctggaggctgcccatcaagagctagatggggacattcccaaggaagaggaagtgagggagaaatcacctatagcctggataaaatatgtccttgcatatagaacagagaagggaaaggtcagagaaaggattgagaacaatcaggctaccggagcagacccgggaacaaagtcctcacagcccaatcctctatactagaaagagaaggaaaatcaataggtactaggcacgaaccacatgccggggtctgtgcttcacgttttctgatgttgcctcagttctgtcccacacattatctgtttagcccctactgtgacctatcttatagataagaaaattaaggctcagcaagattcagaaacctacttagggttcctccgctagccagtggctaagctggcacctaaacctatgtctggaggaacccaaaatttatagtctttcctctgatatccattgttcttcaaagaggattatctgctgttcattaaatgctaactgcatgctaaaaactgttcctagtgcttgatcttcaatgtatcatttgttcctgcaagaaagtcatgattacttttagcaccatcttcattatcatcatctttgctactattattattttcaacttacagatgaggaaattgagactcagaaaagttaaatatcttgccccaagtcacaaagctagtaaatggcagattcaaagccagggatatctaatgaaagctgcgtttcctctttacgagtgcaagctatatggccttccattcataacacacccacaacagtgcaagccaaaaaccatccccaaatctaacttcctaccatattgatcaaagtattcattctgaaagacatcagagcagaaactgctggtttcccacccaatgtcggttctccttttcctttttagaactccagtttaattcagaaacaatgtttctaggtaaaatattctattccccagccttcctccctatcagagatgaccaacaatagactgaaatgctggggtaggatttctgagctcttgaagaaggggcatacagctagagtgtgccctttttgctcttctcctccttattcttgtttcctgctttgagtgtgaatgtgatgcctggagctccagcagccatcttggatcatgaagcaactttaatgatgcaaaccatgtgcttaagagtacaacagaaatacaggaagaggcttaatctatgaggacaccatgaagccaccttggcaaccctcaaccacctacctccaggctgctttaatctgagaaggaaataaacttctcttttgttttagcatttccaggcttatttattggcaaacacaattcctaaccaatatatgcacctgcccgaatactaaaatccaatgaatagagattcctgagattcctttacatactcatttccactcattcactctgatttaaatacagtcaactgtgtgtctcactttgattgatggggtgccatcaaaagcaaaattttctcccttgttgcttctgaaaaagactcccaaacccacagtgaagtcagtctggggcagagagaggtggtgtgatattatatatgtcattataaactctaagtgcctcttttccgaactcttagaaggttagtagtggcaaaggcaacaaaaaagtcacagtgatgaatagaacatgttggaaagtggctcagagagtaggaattaaagaatgccagctccagtaaatgtcacatatcaatcaaaagtgaagaaagggagttccctccaaaagtggcagaggggacaccttcataaacagaacataaaggccaatcgaactcagcagcaaaatgggacgtattcagccagagcctgtcactttgtacaatggcaacaaaccattccgtcagcttctctgctgaaatcagagaagtactaaaagggatttttgaaaccatttgctcagtgcctccattacataggggaggcaactgaggatcagatagggtaatggccggaccaaagtcacataaaaaatgaatggctgaactgggatgagatggaaacccaggtccggtacttgctgacttctccactgatgtacataccttctttatggattgcgagtatccacttctacctaaggcaggagttgataagctttctctgtaaaaggtcaaataggaaacacttcagattacaactactcacccctgctgttgtagtaaaaagcagccctagacagtagaaaacaaaaaaagtatggctgcattccaataaaaatttatgtacaaaaatagctagctggatttgacctgtaggctgtagatggccatgccctgacctatgtcactgggttcaactggtcaccagaccaacagcatccagacctttctagaaatgcaaattgtcagtctctttgcctccagacctaatgaaacaaactccagaaataacattcggaaatctgttttcacaagctttccaggtgactgacacacactaaagtttgaaaaacattgggttaacacgccgggcacagtggctcacacctgtaatcccctgtaaacccaacattttgggaggccgaggtgggtgtatcacctgaggtcaggagtttgagatcaacctggccaacatggcaaaactccatctctactaaaaacacaaaaattagttgcgtgtgatggcatatgtctataatcccggctactcgggaggcagtggtagaagaattgcttgaacctgggaggcagaggttgctgtgagcagagattgtgccactgcactccagcctgggtgacagagcaagactctgtttcaaaaaaaaaaaaagaagaagaaaagaaaaacattgggttagcaaaaagacacatgcactcatatgttcgctgcagcactattcacaataacgaagacatggaatcaacctaggtgcccatcagtggtggattggataaagaaaatttggcacatatataccatggaatatacacagccataaaaaagaacaaaatcatgttatttgccgcaacatggatggagctggaggacattatcctaagcaaattaacacaggaacagaaaaacaaatacttcatgttctcacttataagtgagagctaaacactgggtatacatggatataaaaatgggaatagacactggggatgatgataagtgtgaggagagcaaggctgaaaaactacctgttgtgaactatgctcactacttggatgatgggaccattcatatcctcagcatcacagaatatacccatgaaacaacccagcacatgtatccactggatctaaaataaaagttgaaattataatttaaaaatgggttagaatcatagcaaatcactgtgcatgagccccgcctagccatttctagtacataacctggtatttggcttctagtagatgcttatgacagcaaccataagcctcccacccaaaaatctattctctccttctttaacatgagaaggaaataaaattcttacttaagccattgataatctggattttctgtcataaaccaccaaactgaatccaattgatttagtatcccgtgaatatttgttgaatgaataaataattctcaagcaaatcagaggatctaaattacatgttacaggtaggtttgattagtacagaaccactgcttcaatatacttttatcagtagataaaatcctcctaaaaacagtgtccataggagtcaaaataataaaaaagaacactaggtggtgaaaatattggaaacttctagacgtacagtagccttcatttcttgcaccgccaaaagccgggctgataatggagcaaataccctcttcccaggctcccctgaggaagctgccactttattcatgaccccacagtcaccgtctcctggaagcctttcctaattagagcccttctagaattctgggattttatgtctcagcagtatggtgagaacaataggattgttctgttctgctttattcgaatcatactgatgtgtcatttttcaatgatccttaagttactctcaaacagagagcttttcttacccatggtaggttctcaatcgatgtctatagaattgaactgactttgttggtgagtgttttgtttcttccacgagaacagatattccttcagaatcaggggctgactcttctatttttcaaacaacccccaaaactagccacagcaacatgcaggggccctgcatcaacaggtacttgaatgctggtaaatgcgtcccaggcacctcacttcgttcgcccattttggtgcatcagaacaacgttgtcactggtctaacctcatcttcactccctggggactgaggtcttgcctgattcccaaagccctgcaccagagatcctcaaacattttcaactaggactttatcaacgggaaaaagatggacagcttcactccatgttaacccagcgactccatcaaacctatgcttgtttctactgttcatgcctctacattgatgtttctcaagcttttatgatccaggtctccttgataaacatttttaacctcacattttcctctaatgctatttgaaatggcaagagaaattaatatggtgactaaaacatatcaagagatgtcatagttcaatagaccctgctactaacaaccccaggtgcaaatctttgcttcacatgctattctctgactcttacttgcatagtctgttttgacttctccatgtgcttcagtgaaatgcaaattactgtttgatcccatggactagactatggggaaatctccattgtttcagggcaagattgatattcagctggttgtttatggctggcaagcattcacacggtcagtgcattcatccaaacggacgaatccccatgcctcatcaattgttacactttttcaatgtcacctacctaagaaaatcagaatacaccgtaacgtggagaatccatatgcagataaatgaaagaggagagtcaggaccatgcaaaaaattacagggaaatttagcaaagtctggtgataacatagactctccacacagcattcaacacaaacagaaaattaatctctgatgcaattgggcattcatacatgccagtaagttctgtactttattttaaggtacctcgcctgcctggcatcagttgggagaattattaaccatcattaaatgattaactgtcactaaaatggtagcctgctgccacccagccaagagcatgctgtgtggagttactcacgtgagaaaaaacttgttagcaaaagaatgcacctgcaacccagagcatctactcttgtgacattctatttcggcctccttgttacaaccacgattttctttctctatctagcacaatacatatgccacaggagtctctcaacttcaggttaattacacccatctctctaaggtcagatcttcagaattcatcctttcataaagttgttttaatgcatgtttaaatctctgtcatttgctcactgtgtgacttcaggcaagttattgaacctcaattttcttatctctaaaatagggctaatcatagctcctacctcataaggtttttaaaagaattcagtgacagcatggatgaagggcatctagcatagttcttgacttgtagcgtgtgctcagtagtgttaataattatggaagagctcattggccaccaagtgaatgctaagctggaagaggattggatacattatttactccaaccccatctcaagccaagactataaccctctcaatttcatgggaggttgaccctctgtcatgacattggacaaacattgggagggggggcgcttaacatggtttggtcattcctcccacggtctcagggtgatagatactgggtggaaacatgggtctcttacgaatagagagctgaaagtcacctacccataccttaaagagtgttccttgagagagggctttcggaaatggatttagacatcatgaatccaacaactaagagatcatttatctgtcctcctgacacttccatagtccatctcacccccagcacatcttaggaactgactagaaatattcttcagactttagaaagcagacgatgctcttcatcacggcagaatttcatatcccccggtgttggagtgggaggctgccagcctttgaagtttgggatgcgtcttcctctctgtgcctctcaggggcctttacttctgctacactgcacatctggggagggttgcctgaacactagctcacgaagtggccgctgggctccttcctggagtctaatcctgtctgtctcatcgtgtccttctggaaacatcaccaacttatttatctctgtcataaaaggagaggaggaaggagcagcagagagtttcaaggttaaccaatgtttgcagagtaaaaatggtacctgaagacagatgtatgctgcaaaatagcagttccatacaaatgcaagagggcgtcaaagtcaacagggacaaaactatgggctatttcatgttcctcactgagtaagacctcactcacaatcacttattctgattataaaaatgatgacctacaaagagacccatgtttccacccaggatctatcactctgagaccttaggatgagtgactgaagcatcttaagctgcccctcccagtgtttgctaaatgtcatggcagagggttaacctcccaggagattgagaaggttaaatgagataccacgtgtgcagaggccagcatggtgcccagctcagcagtaggcacttgggaaatgtcacctttaacactgatatgtaagaccagcccatcatagcagcattattcacaatagccaaaggtgggaacaacccaaatgtccattgacagaagaacaggtaaacaaaatgtaaatacatacaattaaatattagccagcgttcaaaaacaaaggacattcggatacatgctacaccagcacactccctagctcacgatattttaagtggatgaataaatgaatgagcaaaaaaagagcaccctacctctaactggatcccccagctgtgaactctctcacattttttctctagcaaattccctcttttttgctgtttctttctcctcttttctgttctattctctttcttcatcccctatgctttaaaagacacttgcatctggggctttttctgaagccgttttttccctcatttttttctgtccacaaaacagcaggaaataatttgctttaaatccacataaaatacccacgaaaaattcacactccatctctgaatgaggaggctaggtttttccaacggtggagccacaaaagtctgttttgacaagttatctccccgtaaacatactggtttatctcatgctgaacaattagatgtgctatttaggcaaaataaaaaatatattgcacattttctagacagcctgttagcatccatgccaatgacacgaacatcaggacatggggctgatattaaagtaaccagaaacacaaatgtgtattgcaacactcggaacattgccatctgtgtgttgcatgcccggagggacacccagggaggactgcgtgaagacagggtgagaaagagtccaggagaaaaacagcagctgagaggagtggggtgggcagggattggagtagaagcagatgggaggctgagattacccacaggctaagccagtggttctatactggggacacattcccacccccaccccaagggacattggcaatgtctggatgcatgagggttgtcataaattgggcagggggtgctactagcatggcatgggtagaggctacatgtcctgcaatgcgtattatatccaccccctccaccccacagcaaagaatgatgtggtcccaaatgtcatgatgccaaagctaaaacaactccaggctaagatgaagcagagtacagatcagctctgctactcagtggctgtggaacttgggcaggttaattaaactctctaggctacaagatggctgaaagccatctgtgggatagatgagatgagatggcagatgtgcaatgcacatagcagctgtttccatgaatgctaatcccttttatgctctccttgtggtcctctgctttcccaaagcgtatttatttactaattcactcagttctttaaccaacatgtattgagtgtctactctgagcctggagctgggtgctggatattcaacaacagataagaaaggcagagaccctgtactagtctgttcttgcattgctataaagaaatacctcagactgggtaatttataaagaaaagacgtttaattggctcacagttctgcaggctttacaggaaacatggtactggcatctgcctggcttctggggaggcctcaggaagcttacagtcatggtggaaggtgaagggggagcaggcacatcacatggccagagcaggagagagtaagtcttggggggaagtgctatacacttttaaatgaccagatctcaaagtaactcggagcaagagttcactcagtaccaagagtgtggcccaagccattcacaagggatccacctccatgatccaaacacttcccaccaggccccacctccaacactggagattacaattcaacgtaagatttgggcaagacatccaaaccttatcaattcccccatggatcatctaatgtattgggagaggcagataatagataatgtacaaaccaaactaaggttagtgccatgagagtaaaggacagaggccagagactaacacccaatctagggtgatcagggaatctgtctctggggaagcgacattgaagcagagacctgaaggatggcagagttttggggattggtgctggttccagacagagagaaccaaatacacaaagactctaagaaggaaagaaaacagggtatgttcaaaactgacagagagcacaggtgacaactgacagagcacaggtgcgtggtggggagcaggtggcaagaggagagggataagacaggtgggtaaggaccccgcagttcatgagaaggcacctaggttctagccaccaagatgtcatgagaagcccttaaaggctattcagaagagaagtgacctgatccaatttaccctggctgcaaaggaaaggatgaagtaggggaggagtagaggtagaagcagggagaccagtggaggctgcttcatctacagctccagatggtgatgatggtggtagcactggagatgaggaaggatctgagatatacatttgaaggagaataattatacattgcactagactctggtggggatgagagaaagagaatgttccaccattcactgggtggtcaggctgggcagccaaggttaaaaggctaagtgtcatccagggaagagaccatcacacgatttgaggttgctgagaacagacaacacacacaccaggctcaagtggtagagcaagaggagacagactacacaagatgcagtcccttgcaatgcgtcagtcccccacagccagtggatctgctctgcagtcaacccaggcagtgcagctgcacacacccacctcgtgctgcagtagaaggacccagatccctttccaccagggacagatatagtagcaggtttggccaggggccattagatgcacacacttgagcagaacaaagtacatcaagcccagaacagggaaagatatttccaggcaaagagatatgcccagcccaggctgggagggctcttcatctcttgttaaggaaatgtttcaggcccaaggccactcatacagccatacagggtccagcaagctgtgcatgaccacctttcccaatgcagtgaaggatagatcccacgtcttgggcttaggcagttaggtggatggtgagtgcaattactaaagagagaaagacctgggaaggaacagttaagggtggggagcaagaggaagacaatcaagaaatgctcagtacctgtgggttccctcttgcctatccacccctccctcctacttctgtttctctaagctcaatgacaatgttccccactccagcagctctagaattcattcatacctgggacttcagtggcaacgtctgctcttctctacctgagtggtagccaggaagtctgagtcttcatcctcaactcggggaagtcctggagcccttccctggacatgggtccccgagatgccagcaatgttttctaggtgccccaggtgctcctgcaccacctcgaagcacctccatttaggcctcctgactttgtttaccaagcacgcctctagcctcgctactcacagtggggtccatgggccagcagcatcagcatctcccaggagcttcttagaagtgcagagtctcaggctccagcccagacttgctgaactggaatctgcattttaaccaaatcccaggtgatttgtgcatgcgtgttaaagtttgagaatcactggtccacagctcagaagccagccatctacaacattgccatatgtcagttatttgtaattacagttaaaaaaaaatgctaccagcgtggcctgggatgatttgttcttaaacttcaagggctgcttgaagcccgagatcctagtgacactgagatatttataaggtttcccttcgtattctctgagcactcctctcatcatcagattttccagatgataagtttttagcaggcccttcttccccctctactcctgtgtggacctctgggctgcctttttcaggttttgcaaactggctatgaattgttcagcggttggattagccagttctgcagactgcctcacacgcagaccatctggaccgcttatagagaagacatgttccaagtaccctctttcctttgtctgcttttctcatgggtactttgccctctaagaagcctactttcctcttttcctctcctcctctccctatttctctttgttgagagagcagtcagattaacccaacaactcttggagtgccttggtcacctgagagcatggaaagtccatgccctcaccagagtaatgactaccatttctccaaaactctcctcatgccatccgataggcagtattgatcagaaggggaaatctagtgtgttaaaattgataaaccagcttaagtaatacctacataaaagaaccatgcctagcacatggctgaatgttgaatactgttgcatggaaatttgggatttctagttagaggctttataaaggtagaatcatgcagacacatatacctggaaatattcggaacattctattagcagaaatgcaatgtaggaagcttattggttctagaagaatgtgtcattgtcagtaattggaattactgacagatccagttgaagtaaggggaaaaccacaaagagtctgtactcttaaaactgcaataatagagtcaaggagtcttacgggacgagccatgaatcttgttaagaatttgggcatgtatctcttctggttgtcctgattatgtaagtcccttcttcaccctaataacactgtattgagaaaaacttcaagtgcattatgcccccaggatgaagctataccttgttaacaaaagctgtgcctatagaaagggattggagtggagtttgggaaggcattgtatagaggacaaatgatgagtctcaccagacagggctcaggtggtaaatgaaagggatgtactgagcctgtactcttgagagcattttgggcacagtacctggctgctgcttctatcaccagtatggtcccaagcaccagccctgcctgccactatcacttcttgaaaggcaacccaagaggagaagtggacgggagccgacaccaggcaggggttaaattgtttatatgcatcatcttgtttaatttttaagacaaccctataggtacagtacttttgtttatctccatttcacagagaaggaaatggaggcacagaaaggtgggtaggttgcccacctaagtgatagagctaaaattcaaaccaggcagcctgattccaaagcccacactcttggccactacataaaagattcttcaccagaatgaccttggtaccataggttcatgatcagaaagtgatgatacctctatctggggacttggaaacatccatagctccttcaatgagcccaggacaatctttcaccatcgtgagagtgagcaaagatgtctcaagtgatgccctttgtggttaagcatcatgaggctgttgcattccctgctggtagggaaattggaggtacgtgcacattccatcccttgcaattctgtaccttccatttgcagcatgagaataaacaacaagttgaaatgtgtttataagagtgaagcatcaacttccaaatccagctgacctgtgtgggttaaaggacttagcaaagagaaacaagtacctacaattttatggctccgatgcctctcagctttggctgcaatttggaagtacccaaggagctttaaaaactactgaagctggggtcccatgccctgagtttctgttttgatttgtctgcactgtgccctaggatggagggaagttgtaaagttctcctaggtgattatagtatgcagtcaagtttgagaaccactggacttagcctctcttgggatctcagaataagtttgggtgggtaggcttctagaataaggcagtgcctctaaagacgtggtctgtggaccccctgacatcagaatcacctgggaatctgcttaaacatgtgcatcctaggctctatccctaaatttagattcagtatttctggggaatatcccaggaatccacatatttaacaagttatctgggtgattgtctgtgctcactgaagtttgggacactagagaatagagagtagtcaaagcctatggctggttttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccctccctcagcctcccaagtagctgggattacaggcacccaccgccacgtctggctagtttttgtattgttagtagagatggggtttcaccatgttggccaagctggtctcaaactcctgacctcaaatgattcacttgccttggcctaccaaaatgctgggattacaggtgtgagccaccgtgcccagtcaagatcccgtaattcttgagcattcctgaaacctagggaaagatggaaagtgcttgcaggcaaggcccatggaagacagaaaaatcatttatagactgcagtctctaaagacacaggagtgttttaccacatgctgatatcacgcagggttggtctggggaagggattctgaagccaggggaggtagttttggccactgaagtcctggctcaatggaatcacttcttccctctcagcctgacaaagcaaagtgggctagtcccatcttccttacctccaaaaccagtacagcattaagaaattcctaatctaccgtgatgtgtgagggtcaaaaaagtgggcctagaggtgaaaaatggatcatagacaaaatattagacatccttcaccctttgtcaaaattaaaaacttttattcatcaaagggcactattaagaagtgaaaatacgaccagcctggccaacatggtgaaaccgcatctctactaaaaatccagaaaaaaaaaaaaaattagccgggcaacagtagcacgtgcctgtaatcccagctactcaggaggctgaggcaggagaatcacttgagcctgggaggcggaggttgcagtgagtgagctgagatcgtgccactgcactccaatctgtgtgacagagtgagacccccgtcacaaaaaaaaaaaaaacgaagtgaaaacacgacacacagaaaatatttgcaaattatatatctcataaaagtctagtatccagggtacatagagaacactcacaactcaacaatagaaaggcgactccgtttttaaaaaaggcaaagggtctcaatagacatttcttacaagatggcatacaaacagccactaagcacataaaaatatgctcaatacaaacagtgattagagaaatgcaaatcaaaatcacaatcagatagcacttcacactcaccaggatggctaaattcagaagaatggaaataacaaatgttgaccaggatgtggagaaataagaaaccccgtacactgattgtgagaatgtaaaatggtacagctgctatggaaaacagtacgacagttcttcaaaaagctacacatagaactcctatatgatccagcaattccatttctaggtatgtatatacccaagagaactgaaaacagatgttcaaacaataacttgtatgtaagtgttcatagcagcattactgatagcagccaaaaactggaaacaatctaaacatcctacaatcaatgaagggataaacaagatatgatatggccattcaatggaatgttatacacccataaaaaggaatgaagtactgataccttctacaacatggatgggcattgaagacattatgctaagtgaaggaaaccagacgcaaaaggccatgtattatacaattccatttacatgaaatttccagaataggcaaatccatagagacaaaaagtagatccatggtttctagggctggggacaaagggagacagagtgacggctaaaaatatgaggtttctttttgtggttttggaactgttctagaattagggagtggtgatggttgcacaatatagtcaatatactaaaaagcattggactgtgaactttaacatgataaattttatgtgaattatatctcaaaaacatttaaacgtaagactaggtatcacttattgaccaatttctccttgctggcctaagtgctattatacatagataaaatttctggctcaatccttcaaagaatcctccaatgaaggagtttccattattatcaaaggacagcccagtgtaggcattgagaatgtggttctgacgccaggccacatgggttaaaatctcagccctgaacttgctgggactttgcatgggtcctctcctatgcagtttcctcatctgcatgtcggggaatataatggtatccagtacctggcgcgtagtcagcacctagtaaattttggttgatcacttaaaggtcctcctccctccttccctttcatcctgagtttgagagtttcacagtcatactaaatcagattaggaaactgagccctagagaaatgacgtgacttgtctaaagtcccgtatcacaaaaagataaatttgtatgcctctacttatatgggatacctaaaataggcaaatttatagagacagaaagtagaatagtagttaccagggaccaagcagcggggcggaatggagagtgattgcaagtaagtacagagactcgatttggaacgatggaaaagttctggagatggatactgatgatgattgcacaacaatgtgaatgtacttaacgccactgaacttaaaaatggttagaatagtaaattttaggttatatatattctaccacaataaaaaggaaccagtccatcaaaatgagtgtcatccaggacagtcaccctacagggcaccttgatgacacatatcaaagtcttaaaaataagccctttgactaacacattctgtactaggaatttctcataagaaaataatcagacaagtgttagaaggacattcatctcgtcaatatctaaaataatgcctctagctgctctaaatatccaaaatagagaattaaatataattaatatgctaaaaaattaaaaattaaaaaataaaatcctacaactagtgtttataactctgggctctgaacccagacagagggactccagaaattcccttagccactatgcttctagacagtgagaaaatccaaaccactccctttttcaatgcaaggaagttcattccgagacccatctgcaagagtgaaaaatgcgcccattgtgctacctgtaaaaagcatggcaaaatgtgaatgttccttaggatcggacatagggctaaccagaccattctcccagcccagcacctgggacatcaggaagcaaagtgggttgaggatcccatccccataggccttcctctgagtcactggtgcaaagtctgtcctgctgcttgtgtttgtttaccctctttcctgcattaggtacagctaagctttgcaaattaactcacaacaggatccagtgggccttgacccaaaaaccatccacaggagaatgttgacgaggcaacaactgctgcatccatcccacaaaacccctagccacaatgccaagtttgtatccagagtggcgacggtggggacctaaaagctaaaacaagagctcagcagggttagggtctgccatgaactcttaccaggcaaggcagggtggagacacatgtccgtggccctcccacgcactaggatctgtatgatgctcctcatctaagagatgagtttggtttaaatttgaactcaaactgtattcttgtcacagacaatccagagcactctctggggtgtggctctgagacacacaaggaggaaaagacccaagttctacctcaagcagctcatagtctggaggagaaagagctatgacgactgaacaaatgcagaaagtaaatatggaagagtcgagagcactgtgaacattccatctgcagctacctacacttctgaaaagccagactcaaacatcaaagtctctccttgcatctccaccaggatatgtgtgtagtaggcagagcactggtccccaacaaggtccacaccctaattcctggaacctgtgagcatgttaccttacacagcaaaggggacttggcaaatgtgattcagttaaagatcttcagaggggaatttatcctggatgacctgcgtggggccaatatcatcaccagggtcacaagtgcagaacctttcctggctttgggtagaaagagatgtgacttcagaagaaaggcacagaggaatgcaatgttgctggcactggagatggaggaagcgaccacaagccaaagggtacaggcagcctctaaaagctggaaagcccagtaaatggattctcccctgcagcctccagaaagaacacagcactgcaccttgattttagcccagtgagatgtgggtgaccagtaggattataaattgatgtgctttaagccactgtgtgtaatttgttatagcagcaaagggaaaaaatactaataggatgtgtaacaggcatctcaagtctatcatccatctcagccacattagcccctgacttcgttgctgaggccaaacattttggtggcatctccaactctcctctttctctcattctgcacaaatccatcagtaaacccagtacatcccacactctcaccactgccactacaagtttggtccatgccacctctcacctggatgacttctgtttccacctgtgccctcttacaatccagtatcaacagtgaagccagaatggccccattagtccatgtttattatctgccccaaaccctgcaatggtgtttcaggcaagaccttgcacagtcctacaaggccctttagagtttggcctccggttacctttctgccctcatctccttccatccccaagccagcttggcctcttaaatgcttctgaaacacactggaaaacacccccacctcagggcctttgcatatgctattttctctccttggaatgctcttctgcgtagcccactccctttgaagcctctttagggtctttatccaaataccattttttttggtgataccttccgtggcatcatatttaagactgcagccttatctctgacgtttcttgtctccaaggtaaactcaggcctggatcagacagctctgcttttagccatccacgtgaaccaggataaggtatttctctctctaagcctctttttcctcatctgcaaaatgcggttgtggtaagggctgaataccattgtggtgatggttccacaggtatatgcctacatcagcactcatccagctgtgcggtttattgcatgtcaatgcctcaataaagctgttaaattagaaaatgttagtaataataatgacaacaacaataatgaagtgcttagtccacggattgaaacatcttcataacatgtgagacactgttgctctgtggtccagtgtgatgaacaaacaccacagagctttaccagccaagtgcctggaaccgtgctggggaaatgacagcctcgtctgttcctcgtgaccacactctcggtgggtataatgcccacttcacaggtggacaaagtgagactcaggagccacacatgtagaatgttctagaacacagaaagtcctctttccagcatgtccttgtggcagattaggcaagacaaggggggaaaagcagagtccaggggggaggcaaattgagatgcaggagggaaggagataagagcaatagggaatcctcagagcacctggcaggcccccagcccctgggggcaggagaagccaggccacgtagtcatgtccccatggagaatgcagctgctcctctgtgctctgccctcggttgctactgccctgcgaggcaacctcgaggctgggaatctcctcctttctctgtctgcagcagctgcagtgaaacaaagggcacagcccccttcaggccaagagaggtgagaagctgctggggagctgatgtcaccactaccccctccgaagcccatccatggggcacagtgcactccactggcagatcccggaaagggagcatgctgactgactggctgactgactgcctgccacatcaccgtctctgcattgcaattgcaaacactgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaaggcctgtgcctttgggagcttaatttctagtagggactggaggagaggggcatatggataataacaaccaaaaaaaatggtaatgtcacagtatgataaaggctgtgaaagaaataaagtgcaagctagagaataataggagagaactgactgggtagtcagggaaggcctcttaaggagttggcctttaaggggagacctgaagaatgagatggagacaatgcagccatgtttcaggcagaggaaaacgctaagcccatggggtaggcactatggtctgaatgtctgtatccctccaaaattcagatgttaaaacctaatcctcaatgtgatggtgttaggaggtagggcccttgggaggtgattaggtcatgagggccaagccctcataaatgatattcatgccctgataaaagaggctccagagagatcaacggccccttccattaccaatgaagaacaaaacaaaatgatgacagccatctatgaaaaaggaagcaggccctcaccagacatgaatcttctggtgccttgaccctggacttaagcagcctacagaactataagaaatagatgtttgttgcttacaagctacccagtttatgacattttgctatagcagcccaaacagactaagaaagcaggaaagagcttggcacaggctgggaagaagtgacagaaagaaggttgctatgataacgcaatggtgtaatcagtgtgatttttatgtgtttgtatcagagaaccctgggtgcaattcctgtatgaagaattgcatgagcactttgtatgagaatgagcaagttaccctctgtgcaatgctgctctcagcgagcaaataagaatgatcatggaactgaattgatggcacttttgtgcatattaatcaaattgattcatgtaaagtacttaatacaccacatacagtaagtgcttaataaatgccaattactgttcttatcatctccctgcctggttgccacaacagcagagtatattcagggcttagcactgagatctgatttgcctctgtaaggtcccctgttaagtttcttgctgtggttctcactcccaaggcagtcatcaaatatttgttgaatgagcaaataaatcaatgaatgggtttcctgattaccttatctttaagccaccaaaaggcacctttttatgattaggcttcctttgcaagcaatgtgactctgccaggccctgggcttttgcagaaagcgaaggtggaagggagatggttattagccactgtctctgcaaacgacaagccatctgcaccccgttacctaagcatagacctctgtgggtgccaaacttcagagcccagaaagttggaagggattccgagcttggatccctcaggctaggctattcttggaagccgagcaacacgcctgccacagggaaatgagtcatgcagaggctgaaggcttgatggatttctccacggcagcagctatttatcagggtagatctatacaccacagaacacaaagggagcgatggagtacagatgagcgctacttaaagcaatatcaccctcaccttgtattgcagatccttgtattgcagccagatgacaatgcctgggaccctcttaccatccaaacacccacctcaaggaggcccagccctgtcatatgactgtccccattatacttgaacagcctttgaagggctttcaaagtgtttcccagccacatctccaccctccaagctcaggtagcccattccttcattcccgtctcaaatgttctgccccagtgaatatcttcgcctccctgttagactctgagatcttgtactgcagaatccactgttgctcatacaattctgagttgtacctgagggcagaatcagagtggtctttttgccttttgtgtttgcagagtcccaactgcagaagagagtgacatgccataaacaggtcaaatgtcgttaatataaatatctaccatggggcaatttccgaggctcttacatgcttcgtcctgaggttagcatgaggcaactgcactcactgctacgccttcccacacttattctaagggacagccagctaggatggagtgggagctgatgccctggattaaggtgcctggttaattccacttgcctggtttcctttgttctcaaactctgcctggagatgaagctattgcgaagtcagtctcagcttgtgcttctaagttctgctccttacatatgcccccagaaagttgttccaagtgaaggcagcttaattaaaaaccacattcaatcaaactgtcactttgtttatgaaaaagtgtctagtggctggaaatggcaagaacaagcactgaagattaatgctctaaattttttctgattaaaagtatgattgaggcattaagaaagctagctccatgaacccagggcaggccttaagcccaacattttgccatcttcaaatacaactggggatagttgtaaaaacaaatagaacttctctctgcctagaggtttcctttcatgaagataaagtttctagctggaactggctgtttttgcagggaagcacacatgagacaagctttttggagtctctccaatacctgcctgtttcataaatggcacagtctccaaatctgatgctcactggaccagggtcaggctatggaactgattaaaataagtaggaacctccaaggccctatgtccctactctccattttcagattggtaagctgagacctatgtactggaaaaataagctcaagggctccaagtagaaatagttgtagtcctggagtcagccttgggtttagctccacttccaaaatgtgtcaacttatagaacccttattttttcatagggttatgaagccactggtctattttatccaacagagaaatcagctccaagcaaatcccacctggacacagtgtctttgcctgactccagaaacaagatggcactctgtctccagtggttccactttacctagatttggagcctccaaaacattgtatggccacactccatctctgcctacgatggaattatgagagagctttggaaaatggctgttccaaaagtggtagtcttaacacaaagatcaggaagaatatttgatttggattaccagccacagcaggcagaattctaagatgttcccaaagtgatagtcttaatccacaggaagaatatttggtttggattaccagccacagtaggcaaaattctaagatgaccaccaatgacccatgtccttgtgtgatctcctccccttgagtacaggtgaacctgtgaatatgataggacatcgcttctgtgattatgttacatcatatggtaaaagtgacaagattttgaagatatcattaagttccctaatcagctgactttgagttaatcaaaagggagattacccaaggtgggcctggcctcatcagatgagccctttaaaagaaggcttaaaccttccctgtgctcagagactggaagcagcagagccctcctccactctccatcactggttttgaagaaggaggcctctttgagtggcctcctcatttcccatgagataataaatgggtgtcacctgctaagttggtggtcggttgttacacagcaatagatagctgatacacaagccaagaacaaataatacctacagcagtcaagatagtgatgatgtcagtgccgagatgagaaactagcaccagacattctcccacatgggcttcctttaataataataaaatagaaaaatcttcaaaacctaactggcccattttcttttcctgtcattcttttttaaaattaaaagccaacatgggtacccagggctgacttgatcacagcatgattaaatgcacttcctctagaagttagggaaaagaggactcagtgagcataggaagaggaacaagtttctctttgcaaaaacataaaaaaataaaaaattttcaaagaaaacatccaagtctcaaacctcaaacctcaaaccacttcatccaagaagaaacccccacatttgtcatttgcagaagctacagtagagacaatgcaaacaggagctagttctgggtgtgcaaatctgtgacaggtgtgcaaggcacaaccagtccttgcgtgatttcttccaaccgcagactccacgagtgcttatgtacatgagaagacgtgtgtggcccctgggagaagggagcaaccattaggacacaatatttaatgaagtgctaaactgtgcatggctgggtttaaatggtgacctttgagtaaagccagtttgatctcaggacatttccttttcaggaattacttgtatagctacctgatgcagtcaagataaagatctaaatcactgagtaaggcctatgaggcccacgtgctttcaccctgacctctctctaccctcttcccctgctactcctgtctgcatcctggactgaacttaccaaacacgctcatagagctgcttctctttacaatgttcttttctgcacctcacccccgatccctactctcctacctgacgaatttatctttcaagacatgctttataaagtcaccttctctaagaagtcttcttgaattctttctatgaagagtccttagatagccccagcatggcctgtgctcagtttcctcatcttttcaacagggacaaaaataggcattcagggctgagtgtggtggctcatgcctgtagtcccagaactttgggaggccaaggcaggtggatcactaaagctcaggagtttaagatcagcctggccaacatggtgaaaccctgtctctacaaaaaaatacaaatatgagccaggcatggggcacatgcctataatcccagctacttgggggttgaagaaggagggtcgcctggacccaggaggtcaaggcagcagtgagccgagatcatgccactgcactccagcctggacaacagagtgagaccctgtctaacaacaacaacaaaaggcattcagttgtaaaaattaaataagttgacaaatatcaaaggcttagaacctggtgacatgtcttcagcacacagtaaacactcaatgactatttatattctttactgagcacctactaagaaccaaatgttgtgccagccccttgaatacaaaacaggcatagtctctgccctttttcccactcagcactttaagcatggggctgagctcacagcctcatacagagcaaaccccttttcatgtcagtcttgcatataagtgagtcttctctccgaaaaactgctgctgggataaaagacttcctggaacctggggtccaacaccaaggccactaagaccaaaagacaaccccagtctctgaccttatttagaattcctgttcataggcggcaagaaaaagaaagatgtaacaatatgacccccaagaaggatattcccattctctagcaaaatctcattttggaattgcatgttgggtgcctgcctcttactaccatgcctcttctcagctggtgtcatctcctctggggaagtttttcatcatctttgctcaattaggaattaatctccctcatctgacttttctagtatgatttttcattcatgtcttaatcaccacctgacactttatttatttatttatttatttattttctgcctccaacctctgaaatgcaagctccgtaagggtaaaaggatatggagtgagcttaatgttccacaactgggacctaggtcagtgcctgatacatagtagacaacagtctactgacacatagatcaataaatatctattgcataaatgataatagtgttagtagcagccaacactttgatacaatttcctatgcaccaggaaccattccaagggccttatgtatattaactcatataatccctgcaacaactccctgagctaggtactgttgtcattcccatattgggaagaaagaagcttggcagggagagttttggtcacttgttcagttatatagccagtgagttacagagtaaggatttgtcaactgaagaaacacgaggttcatgcatctagaaaggagagctttatttcttataaggggttgcagcctgtaagctgaccatctcgcaggctggggagtgtagcatccagcagaaaccagaggcaggcacttcaaaggaggcaaggtgagacaggaatttatgctaacagaatggctaagtatacatactcaagttataggaggagctatgaatattcacaaaagaagggcacgcaaatgcacagtaaattaatatgaatgtcatatacatgccatgttcattttggggtgaaaacataacatttaagtatactataatttggccccatgtgtcaaaaggtgaattagaggacatgaaggcactcagtgtgcagcccccgtaaactgaccagaaccacttcatgcaaacagaagctagttctgggtgtgcaaatcttatcaggaaggaatgttgcttggttggccgtgtcaaacctgtataaagcgaggggcagagtcaggtggttggttggaaacagtgatggaacaagtcttttgagatggcctgtttctgtttaacccttaggaaagaaagccaaatgatggttagcaagggagaggatataatgtggtaagtctgagctcctgtctggttatggctaggaactcagttttcaaggtttctctgggatccccctggccaagaaggggttccatttaattagttggggtggtttaggattttatttttatttctaggattcaaaccaaccagtctggccccaaagtttatgcgcttaaccacaacactagaatgaattagttaattaacaaacaaaaaatgtcacgtctgtcacattctgtaatgcctggggccatattgggggatgtgcctgtgtgctccacgggtgtcctcttgaatgttataacctctacatgaagcaaaatcctatgtcctgcacacagtaggcactcagaaagtgtttgttgaattggatgacacctgagtttgtgcttctggacattctaaatacttttttatgcaaatctccagctttccttcccatggagactcacagcacctatgcagcaaagtgcattgttggtggtccctatccagagcttctgacaataagtacatcaaagctagggtgccacagtgacactgccatcagcttctgggccacaggaatgctcaacagatgtggataatgagtatggaggagcaatgatgccaaaaataattgttccttgggccttctagatcttctcacttcccctgaggagagattgtgcattctgcctacccaggaggacaggcaagattgcaaacacataagatgtttgtggcaacaactaacagctgtctggccagacttaactgcaagtgagcaaatcccgccttcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcgtaggcatatgctacccctaggctaatccacagacctcggggaagagcaagccgcagtgctaggctgccaagctctaaaaatacccagctcattcccaccatgacactcatggtaagctcttagtgggcaggaatcctgccaaacaaatgcctacctagctggatgatccagaatgagcccagaggctggggactatgcaaacacaggatccagatagggacatggttttctcttgagcatgaatgaagttttaagaaaactggtgtgtgtggattaccatgaattggggaggaggaacaaggagtggaggagaagctcctgctataacaatggaagtcgatgaatgcagtggctaaagctgtaggctcgagagtctgaccaagtccatgcaaatcttgaacctctcacttaataaatacacagcactggggagaaagttaacctctctgagcctcagtttccacatctgtaagaaagggacaatgataataatcactactatatctaccgcattggtttttataaggaatgtaatagattatgttattgttcaaatatctgctgtccctcctctctacaggactcctccctactggacaattggaatcctcgccaatgttgggctgggagccagcggaatgtaagtgggagtgacagtgccacttccaggagaatctttaagatccatctcttcatctacatccttctcttttccctcttccatgagattagcaatgacctagaaaggagccctccgtcagtctgactcttgcatctaagacatgaagcagagctgcaactaacctcatataactggaacaagaaatcaactttcataaacaactccaaaatctcagtagcttattactgtagcatgaacctgcttaaactgactgatacaacagttaaattatatcatctatataagagacttaatgcatatctggcattttcttttttatttatttttgggcagggttggggaacagggtcttactctgtgacccaggctggagtgcagtagcatgatctcagctcattgcagcctccatcggggctcaagtgatcctcccacctcagctttccaagtagctgggactataggcatgcaccaccatgcccagctaatttttttttttttttttttttgagacagggtttcaccacgttgcccaggctggtctcgaactctgggctcaagcaatctgcccacctcggcctcccaaagtgctaggattacaggtgtgagccaccacgcctggccttagcaaattctaagcactcagaaaagttactttattattgctattatcagtatcatcatcatgggttctcacccttttggagacatcccataccttgttgaaagcttttgttgttgtttactcatgaaacctttggaccctctcccttgagaaacgcacatttggacacaattttgaagataagtgcaggtagtttgcacatcccaggctcagagcctctgttagagtctcccagattgaaaaattcatcctaaagtcgatttcctaagcttcggcctggaaatactgccaacatagactctgtgtcatgtcaactgtcactgagcacaaacaggtaaaaatgccacagtgccactttccatcctggacaaacagcccaggacatacagggaggcagggattggcacacatggaaggagagtgctggcccctggctgcgtcctcacctctgtgctcagggctgtgagtgaggatggcagacacaacaatctatacccaccctagacctgcggcatctcttaatctgtgctccacaagatcagcgtctgatcctggggccgcgggctgtctggggaacatgcagttctttagtgtctggatatcattagctaatttgtgtgtccaatttcaaagaaatgtttcctccctagaggagtttctactcaaaggactggctatttttggctcccacccactcggctgtgttgtgcgaagccagcatttcctagactatcccaacccccaccttttcctctctccagagtcagcagcactggagtccaaaacagtctcctgggcatccccatagccttgtattcccatccatctcgcaagaaaagataagtcagcactcttgtagaggacatgcttccaactaggatcaagggaagagcttcattcaccctttctttctcttattcatccattcatttgtttaacaaataattattgacacccttctctatgccccattacatattgtctgtatgacgttgagcaagttacataatgtctctcctcatgcctcagtttttttatctaaaaaatgggatgacaataagaacaacccaagaggccactgtagttattaagtatattaatatatccatagcatttaaataatgcctggcacaaagtaagtgctcggtaaaatgttagttgtactttgtcaactactgtagtaatcaatagggacaaaacggtgagtgaaaactaatacagttcctgcccctacgaagctgatgatccccgaggagaaatatacattaatcacataccctggaggttaaagatatattcagtactccttgattttggtgatggtatcacagatgtatgcatatgtctagattcattgaaacgtttacagtaaatatgtgcaattttttgtatgtcaactatacctcaaagctttataaaataagcacaacaatgaatgttaaatatgtaaccaccataagtgttaccaacgagaagcatatggtgggttccaggagggcagttgatacaggttatggtttaggaacgatttttctaaggagtaatgatgaggttgaggtctggagaatgtctaagaattatgagagagtttggggtatgtgtgcttctttccgggagggttgaggggctctgtttcagacagaagaggcaacatgtaggaaggtcctctcaatatctaacactgttagacatataaaacccttgataataataatcaaataatcagataataataacagaggtctaaacgggaaactataagatttcaacagcaagctgtcttgataaggttccatcatctctcaaaaatttataactaacaacaagacaattacttcccaaatccccttgaaattaattccatcctcctccaggagctatgatgggtgggaaataaaaccgatgagggggaggctcaagtagtagtgatcatatcagagcatatcaaaaccttggtgaatttttactctttagtttgacatggaaattttccctaatcccaagacatagatgataccatgtgataaaaaaaaatcttaagatacatttatccatttattttacagcttttttagtatttaggacctaccaggcattatatgaggtgctaaagacacaacggtgaccaagacacagtctactggtctctgtcccctatactctattttaccatatctatctccaaccctgtcagacccaagagggaggggtttccagtagccaaaaaaaaaatagacccaggcaaaataattttgaaatagaaaaacaatggtgaaggacttacattaccctcatttcaaacatattacaaagctacagaaatcaagagagtgtggtattaagggaaagagacaaatcactggaacaaaactgaacgtttagaaataagctctgacactgtcaattgatttttgacaaacatgacaggataatttgataggaaaaagatagtcttttcaacacatgatgctgggaaaatttgatatcaatatgtgaaaaagtgaacttaaatccttatctccaaaccacacaaaaattaactcaaaatagatcttagacctaaatataacaactaaaactataaggctccttgaaaaaaaaattagagaaaaccatcatgtccttgggttaagcggaaagctcttagacacaaaaccattcattattcttttactagacataaatgaaaaaataggcaaattcatctccattaaaatttaaaacttttgcactccaaagacaccattaagaataaaaagacaagccagactaggagaaaacatttgcaaatcatacatatgataaagaactgtatcaaaaatatataaagaactcctacaactcaataataaaacaaacagctcaaaaataagatgagctaaaaaactctatactcaatagttatttcatcaaagatgaaatacacatggccaataagaaatgaaaaggagttaaacatcattagtcattatggaaatgaacattaaaaccacaatgagattccacttccatatacacactagaatgactataatggaaaatatggacaacaccaagtgttggcaaggattcacagaaactgaaacccttgtacattgctgatggcaatgtgatatggtgcaactacctgtgaaaacagtttggcaattttttaaaaacttaaaacgtaaagttactatatggcccagcaattccacttataggtatcaacccaagagaaattaagatatacatccacacagactggcatatagatattcacaggagtattatccctaacagacaagaagtagaaataacccaaatacccatgagctggtaaataaacaaaatgttggctgggcgcagtggatcacatctataactttggaggctgaggtaggtgatcacttgagccaggagtttgagatcaacctgggcaacatggaaaccccatctctaccaaatacgtatgtatgtgtgtgtatacacacacacacacacacacacacacacacacacaaacacacaaaattagctgggtgtggtagtgtatacctgtagtcccagctactcgtgaggctgaggtgggaggattgcttgagcctcggaggcagaggctgcagtgagccacagcctggggaataggccccatctcaaaaaaataaaaaataaacaaaatgttatatatccagataatggaatgttatttggaaatagaaatgtagaaaacactgatacatgtgacaacatgaattaacctcaaagacattatgctaagtgaaagaagccagactcaagagactatatattgtatgattccatttacattaaatttccagaaaaggaaaatctatagagacagaaagtggatcagtgcttgcttggggctggggttaggagcaatgattgacaggcctgagataatttttttagggctggtgaaaatgttctaaaatttatttggggtgatggttgcaaaatctgtaactttactttaaaaatcattggattatgtatttacaatgagtgcattttatgataagtaaattatatatcaataaaggtattaaaataattaatcctctaacagcccacacaatagtttagtcatctgcatgccttgatatacctccagtctagtcctttcaacaaagaatagaagagtttagtcaaatgaggagtctttgggattggaatggttctagcctcattctctaaataattctacccaaacaatatttaggaataatttttttagagtggcataaacaccataattacatgcacatacttttcatcttttctgttctagaaaaggagtcttcttacagtccaaggaaaatcagtctctacactgaattataaattaacatttcagcagacatgcaatgttgtgtgaggtcttcccacgttagcagtcggaatacaggggacagcatcacctcctttgcctccagaggtctgagggtgcagtggaaagagatcagggtgtcttcaagagtttgaatttctctcttctcaagaatagaaggaaaattaagcattatttttttctctcaatgattttgccttttataataagtaactcttatagactccttactatgtgacatgccctgtttcaaacatataaaatatattaactaatttaatgctcataacaactctatgaggtcagttctattttatcccttttaacaaataagtaaactagagcacagatgggttaagtgacttgtccaagatcacacagcaagctagtagagacgggattcaaactaaacggtaactcaagtcccttctcttaagccctccatctcatgtactcagaggcattaaatctcaaggtatacataaaagataaggtaaaaggcagcatgaaaagttgctttttttttttttttttaacaggctggagtgcaatgccacaatcttggctcactgcagcctctgcctcctgggttcaagcaattctcctgcctcagcctcccaagtagctgggattacaggcacccaccaccatgcctggctaattttttgtatttttagtagaggtggggtttcgccatgttggccaggctggcctcaaactcctggctcaagtgatccacccgcctcagcctcccaaagtgctctgattacaggcatgagccccacgcccggccaacctttctgaaacccagaagaaagaagagcaagtggggctcagagtcacagttgctcagcactgcaggcagggtccgtatgtcataataacagatggggtaggtaccattgctcttgcagcctgcaggtcccaaaggaaattgtgtcattttatcttgcctagctccaaaaggagcagcctctgtcagaagatctcaatcatcataggcacatcccaggtgtgtgtcctgcttctcatcaggcctccccatcttactagaccactaggttcagccctgacttgtaggaggggctgggcctccatagcttctaaaaacatacagttaatctacagcatctctcctacatttgctgcgtagcattggcaccttcactcaagtgacagtattatagtcaggtggcatcgatcagctttaatcagccttatatttaagagctagagtctctgggtgttttagggaatacccgggcaacaaagtgaaaaaaaaaaacaaaaaaccttttgcagtagattgcatgattgcacaactggcccaattcttcatctcttactggaaacatgtcactgtcacgtgattctgtggtccctgccacttaagaaccaggatacagttcctcacctcttgactttgagtttgatcacgtgacttagtttggccaattacgtgagggagacgtgccagtgtgccggttttggcttttgcccagggtgtctaagaccgtagggaagagattgtctgggaaactctgcccaagacatcaccagagagcccacgtagtgtggtttctctccttgtatcaatgagaatgaaacccaaagagaactgatgcatcacccagtgagtgaatataggagctacagtgaaacccatgtctcctgtcctcctactccaggtttctaaacaggaagcatcagaacctggctgtcagaaaaataatctgaggccccaaggtttcatggagcagttactctctgctcagcactaagccacgtgtacagaggagataccaataaggaaaatgactgggtccctggttataatgtcctaaatctgtaatggagtgaatcaacaagacacttgcaaacaaaatggtgagggctcaggaggctgtaatttttaaaaagtgctggactgaggaaaggtgagagttacaggctcagttctgccactcgcctgctgtgtgactttgagctggtcattccctatctcttaataacagcttcttcatctatagaatgtgggtatacatgaggggatttttttagaactctagttctcagttctgactgcatattattctcaccaagaaaacagttttttttttttgagatggaatctcgctcttattgcccaggctggggtgcaatggcacaatctcagctcactgcaacctccacctcttgggttcaagcgattctcctgcctcagcctcctgagtagctgggagtacaggcacccaccacaatgcctggctgatttttgtatttttagtagagacagggtttcaccacgttggccaggctggtctcaaactccttacctccagtgatctgcccgcctcaacctcccaaagtgctgggattataggcatgagccactgtgcctggcccagaaagcattttttaaaagaggaacccagacccttggagaaatgactgattgctgattccagggttgaagcaggaaaagtataaaatgaaccaagagcatcttattgttccagaaagtaagggaatgtgcaccaaaaaaaaaaaaaaaaaaaaaatgaggacttctagggatggaattttgtcccctacaaattcatatattgaagccttaacctgccattgactatatttggagatagggcttttaggaggtaactaaggttaaatgaggtcataagagtaggaccccaggttgataggactggtgaacttgtaagtagaggaagaagagagatttctctctctctctctctccaccagcatgcactgagaaaaggccatatgagcacacagagagaagacagctgtctgcaaaccagtaagagagcccttactcaaacccaaccacgccagctccctgatcttggacttccagcttttagaaccatgaaaaaaataaatttttgttgtttaagacacccagtctatgatattttgtcatggaagcctgagctcactaagacaagaatgtgtcaaaagaatacaagagccaggttgaggtgctgaccgataaaatctgagacaatttaagcataaatataaataacgacagtaatggattataacccactgtaaaattaagaatcttgagcccatgctaatataaagtataaaagtaaaaataaatgttcttccttatagcagaacactagtaaagagaaggaatgatggagttagaaaacatcaatggatgctaaagctggtgagtaaaaacatgataaggaataggatatttatatagtctcaatgtatctgcctaataatataggagctacattgaaagtgtatcccgtcttcctagtgcaggtttctaagcaggaagcatcagaacccagcatcagaactccctacaagttacttgttaattacaaagaggaaatagcaactttacagtagagactgcagatactaccttaaccacggagtcaaaattaatatcaccaatatcaagaccaacggacatcatctcttgatacaatgcaccaagaaggacacaatatcacttcagtgatattcctacaaaaaaaaagtgtgaaagaaatagggcaaaatgtaagcaactggtgaatctgaataaagagaatataggagttctttctactattctttcaacttttctgtaagcttgaaaatatatctactcatgacacaagtttacctgtgtaacaaacctgcacatgtacccctgaaataaaaagttaaaaaaagaaaatatatctaaatgcatatacagtttaaaaaacatatgagcccaagccccaccccagactaataaaatcagattcactgggggtttagggcccaggcatccatgtttttgtttctatgtttgttttttaggctccttgggtgattctaatgtgcctcctaggttgacagcccctacgggactcagaggatagtgacattctgacattctctggacctgtgggtaccaaagtaaatggtttacagcagttcccaaccagcagcagcacctaaccacccggagacttgtaacaaatgcagattcttgggcctcacccagacctactgaatctgacacttcggtggtgtaccggcaacctgtgctttaatcaggcatctcggggtttctgatgttcactaaagtgtgagaaccatggtctatattgattctcaggtaactaatagtgttcttctttttcaattttttttaaattgtggtaaaacacacacacacacacacacacacacacacacactttactctcttggccggtcagcatagacttccagccccacatcacctttcccaaatgtcttccaaggggcaaagtccagacacaacagtgaaagtgtggattttactccactgttctaactatcagttctttcttgctggtggtctcatttccctgccctcctccttacctgtgccacataccccattctccttgtacttcccctactggtcagtcccccacacatagacctgctacaaccacaactaactccttgagactaacctgtcctctccatcactctcaagccacattctctgagcctgcccaggagactaagaaccaatgtggaattaacaatttactgaaaaagaccagatccctttcccaggtgtgaggctatagcacgggtgttagctgtgataatttttaggtggtacaaggagactgaattaaataacatcaagtcacatggtgcaaaagttgctccctttcaagtctgtttcaactcttctgaaaacatcagggaaaaagtcccaaacaccctacaacactcgctaatctccctttttaacagcgagatcaggcctcaggctctgagccttaggcagcagtctctgagctgtttggtcttcgtggtatatatttttgcaacttactttctatttgtgggaagtgatactggttttccatttctggctgtgatgccaagttgctttttaaaaataaatgtgcttaaattaaaatgcaagtggtttaaagcacacactaaacaaataatcgtagagatgtttgaagttggaaaacagagaatgaggacccgggcttcttccctgtgaaatcttcaccctacatatatcattttggtgtcttggagactgcatcctaccatgatctcatctatgaagcaacaggaaaggaatggagtctccagtgagattggatcagcagtttcattagaggggctggcagagaacacttttgctcttcctcctggtccctaagccttcctgaaacccagggactggaaagggatcctaaccaaatctgcagctattggcatatcctagatcctagtgagccagaggtgggcagtggtggggacagggatggctgataaatgtgggcagatccctaaactgcatccgaccctcctgcactttctttcttaagacccttcatctaacatgtaggagaactaaagtggatcctcatctctcaccttaagcaaaaatcaactcaaggtggatcaaggacttaaatctaagacctaaaaccataaaaattctagaaggtaacacgggaaaatcccttctagacattggattaggcaaagatttcatgaccaagaacccaaagcaaatgcaacaaaaacaaagacaaataggcggtacttaattaaactaaagagcttctgcacagccaaaagaacagtcagcagactaaatacacaacccacagagtgtgagaaaatcttcacaaccatacatccaaaggactaatatctagaatctacaaggaactcaaacaaattagcaagaaaaaaaaacaattagcaaacaaattagcaagcccaaacaaaagtgggctaagggcatgaacagatagttctcaaaagaagacgtacaaatggccaacaaacatatgaacaaatgctcaacatcagtaatgatcagggaaatgcaaatcaaaccacaatgcaataccactttattcctgcaagaatggccataatcaaaaaattaaaaaaatagacattggcatggatgtggtgaaaaggaaacacttccgcactgctggtgggaatgtaaactagtacaaccactatggaaaacagtgtggagatagcttaaataactaaaaggagaactaccatttggcacagcaatcccactactgggtatctacccagaggaaaagaagtcattataccaaaaagacatttgcacacacatgtttacagcagcacaattcacaaatgcaaaaatatggaatcagcccaaatgcccattaatcgacaagtggctaaacaaattgtggtatgtatatatacacgatggaataaaactcagccttaaaaaggaatgaattaatggcatctgcaccaacctgaatggaactgaagactattattctaagtaaagtaactcaggaatggagaaccaaacattgtatgttctcacttgtaagtgagagctaagctatgagaatgcaaaggcataagaatgacacaatggacgctggaaattcaggggaaagggtggtgaggaataaaagactacaaattggattaaatgtatactgctcgggtgatgggtgcaccaaaatctcagaaatcatcactgaactactcatgtaaccaaatacctactgtcccccctcccccccccaaaaaaaacctatggaaattttagaaaaggaaaaataaataaataaaactagtattgatttgggttatttcagtttgtgttctccaaatagttgttaaaaataatttagaaaatgctcaaaaaaaccactcatctagaggaatttagatcacagcaaagaaatttctaacattccccataccttgtgcatctgacctatgatttttttccttgaccttaaaggcttacaaagggcatcattatgagtaactgcaaaaccattatgaaaatcaactccctattttggatgactccccatgttcagcataaaagatacttactcaaaagcttggtgttttcattccagaagaaactccttttaatgctgcaagcagcattacaattttacaagagaaaaataaaacattcttagtaattaaatgcaaatcaccagagctcagaattcagggccctgtctctggagtgcctagattcagcactgggagaagcaaataactgagagaaggaaagagaatgccatcctgtctccctcccttgcacccccttcctcagctaactagtgttcccctggctcaaagaaaatgtggaagttggtggtttttcacaaggatgatactatctggagctgctgtcctctgagagtaggacgggtcagaagagatctgcacctgctctgttaaggtagtcttgccatctctaagggtttgatttgctggcttgtttactggagtcagaaacagaataaaggtaactcacttcaaaggctagattcaaatgctacttcctagaagataccttcaggaccctccttcactcccaaatagaaggaactctgctttttcaacatggtattgaagtcagaatgtttgttattccaaacaccagtactgaaacgtctgctcattccgtgaagttcctgaggtgccgagtgctggggatataacagtgaagatggataattctccattcttacggagcttcattgagggagctcagggaggcaggagttagtcaataatcacaaaagtaaagcaacatcacaaattgtagcgagtgctatttaagtacatgaaaacaatttactagtcaagaagtatcagcagaatgaacagcaggtgcaaagggcccatgtcagacaggtgaaggggggacatgagggcaactgcaagaaggccaatattacttttgcaaggagcaggtgagacgtggggctccagaggtagccgaggtcagccatgaagtgcttggaaggccacagagacaaattttattcctatcaccatagcaacgggaagccatgaaaccgttttcagcagagaaacaacatgatcgggtttgcattttgaaagatcccactggcttcagtagagaggatagattttgagcaagaagcaaagatgcttgtgcaaaggagagtaattcgaagacctttggtagtcctggcaagagatgttgagtgttggatcacagagctgctgatggaaatggggagatgtatttcgactgatgttggtcaagttacttctttctgcacctccatttcctcatctgtaaactgggagtaataagcccactcacctcccagtgaaatgagatggcatgtagaaagcacctggcacatcctgatgattcaataaacgatagtcgttgttatagtgatgatctttgtaactcttgtaagatgcttttcagttcacatctttttaaatgattgtctgtccacactgttcactccatctgtgcagctttatgttatttgaaggcatagtgcccccctgctggattcactttataacaatcagttctcccaccaggatgattagcgcccagaaagtgtaagtaaatatttgtggagaaaactgatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccgcttttgagctgaggtcacattctgccagagcagtcctcagccagtgacagggcatgagggggacatggggcccggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaactggctcaccttggagagaacagaaactaaaagccacaacatgaagcgtatacaagaaccaggtaagttaagtaactcagagctatctcttgtcccaaaggatgaaaacctccgagcgccgtggaagagaacagtctgattaagttggctcaaactgccaggaagctttctgagcaacagcagatgttggggcttcgagaaagattgctctctgcttttggccagaatccctggggtcatttaggtggtgatgttgccagttcttctcccctctggccaacacctctcaatccattatttgggataccaattataaacttgggacaagagcctaatctcccagcaaggaaaacctgggctgtcagtctactttaccaatccctgccttggaaattgctatatatctcaggctacaagaaagtagagggagacaagagaaaaagcatccctcacacaaccttcagatcttccgctggagagatagccccactctaggagggaatggttattgctataatttgggggatattttggcaggtttgggaaaatctattcaaagtttagtttagtctcaatttctagaacatcgagccacttttgtgtaggcaagggtgacaggaaaagctgaaaacatggtggtaatcctagagataatagtaatagcagtatttatggagcaatgagtatgtttgtagattgagaggggtattttttacagaatcagctcatctaatcatcacacgaactcctagacattggtgctattttcaccaactatttcaataaggacacagaggttctgatatggtttgggtgtttgttccctccaaactcatgttgaaatgtcacctccagtgttggaggtagggcctggcgggaggccattagatcatgggggcagatccctcatgaacagcctagcaccataaccctggtaatgagtgagctctcgctcttagttcacatgagatttggttgtttaaaagagtgtggcactgatcccctttctctcttgctctgtctttcaccatgcgatatgctacccccctttcaccttccaccatgattggaagcctcctgaggcctcaccagaagccaagctgaagccagcaccatgcttcctgtatagcctgcagaaccgtgagccaattaaacctctcttctttacaaattacctaatgttgggtatttctttcttctttttttcttttttttcttttcttttttattgggggggacagagtctcactctattgcccaggctgtagtgcagtgttgtgatctctgctcactgcaaccttcgcctcctaggttcaagcaattcttgtgcctcagcctcccaagtagctgggattacaggcatgcaccaccatgccaggctgccttgggtgtttctttatagcaacacaagaatggactaacatgggctcagagaggttaggtaacttgtctaagaccacagagctagcaagaggtagagctaggattcaaacttaggtctctccaaaatcaaagactacatttatcctcccttcctccactgttctagatcactcttgcactggggcactcttgctctgagagacgtatcccactcacagacatggagtggatgcctcggttgctgcatcatttaacaagcatctattgtctgctctgtgccatcccctatggtaggcactgggacgaaaagaatgaatgatccttgacatcaagaagctcaaagactagctggaaagatactaatatagcaattccttttattttctctaataggagacccactcgcaactatgaggaatagatactatcagcagcaacagcaactttttttttaaggacaaagaaagtaaatatgggaaaatgtaaacttgtccaaagacatacatctagtcatgagaaagctgaaacccaaaacagctaagctgatgtatcacagcctctgaatcaccatcactgaaagaaacaacacacttggggatgggggagtggctctccttgcacaagctgggatgcaatttgcagacattttgcagagcagaaaatatatgagtctctgaagggcagtgatcaatcatttcagccatcttaaatgagaccagaatagatacaagaagaatctcagccacatataactctaaccatcaagggtattactaacccccaaaatatttcatcttcttgaagttttatggctatggctcttgagtgttttgggggtacagggagatatgggtttaggcagctgaagcaatacctatctatagataagaatatcgccagaagtcctaataacctcagaaaatctacaaaacaagagagtccatatgtatgccggaatccctgcccctgacatgtttactctgctgactacctccagtgacagaactctagacttaattagccagctcatagctcttccacatactttttggaggtagattttgtctctatgggctctacttcttcccttagattctagagcaccatggaatgtatctgctctatgttcaagatgaaagcccttcaaataattgggtatagcaatctactcacccctctcacttcctcatttctctccactctcagaaatgcaaacatttatccttttgttgatgttattcaggaaccacttccagcagcctgtacctcccttagtcatgttccttttaacaagctcagtttatcaatgtccttcttaaaatacagaactcacacatgagcataaccgaagatacaatatttgtgaagggactgtgaaaacaagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccaggagagaaaagagaaaagtggatggatatgaacactatgtagaaggtgtagtcacagggcgaggggtgtgagggaaatggtggcagcaagaagttgagcctgggcatctgggaggatggtggtgccatgccctggaggaggaccagtttgaagaaagaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagcataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccgagattaaagcagtgccactctgggtctggagccgaactggtagctggggtctagaagaattcagagttcatcccgagtcttctctagagatggaagcctggagaagcctggagaagcctggggaagccagaaggccctgaacccctgacaaaaagcctaaggatcctcacccagcaatgctgaccacgaccattaaaacatgaagcccacccccaaagaggaaaatccttgccctttaatgaagctgccaaaaacctccaaatttaacagtttgcactgtgtctttctgcagacacagaaaaatgagctgggaaatagaacagtcacatctggccaagagagttgtggacttttgaggtgttgcctgggtctcctgggcagtagaatcagctgacccaatgtttaatagagaaactacaaattttcaaacataagaaaaccatgtaaaaaaaaaaaatcaatgggggagggggtgtttaaatgcatttgagaccagccatatgacagcgatttggaagcccttataacccttagttttaataacataagaattccctatgaaattctaaataaggctgggcatggtggttcatgcttgtaattccagcgcttaaggaggctgagttgaggtgggcagatctcctgaggttaggagtttgagatcagcctggccaacacggtgaaaccccatctctgctaaaaatacaaaaattagctgggcatggtggtgcgcacacgtaatcccagctacttgggaggctgaggcaggagaatggcttgaacccaggaggtgggggttgcagacagctaagatcgtgccactgcacgccagcctcggtgacaaggcaagactctatctccaaaaataataattctaaataaagcaaaataaaatgtatgcataaacatatatatgcaaaggtatatgtatatgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataagatgaggcatgcgtacttccccatctgaaatagccaagatgatgaccattcttataagtgaaagagttttttttttttgtttggggaagtgtttttttttttctttttatctttcattcctgttcaaattcttttttaatttacacataagaaaaagtggtctggcacagtggctcacttctgtaatcctagcactttgggagactgagagggaggactgcttgagaccaggaattcgagaccaacctgggcaatatattgagaccctgtctctatttaaaattgttttaatttaaaaaaatttacaataaataaataaaaataagaaaaacctcccaaatcccaccactctagtacaaccaaagtggccacaccatcacacgtgaggttgttcacagcatccttctctggggatgattctaagtcccttgaagatagggagcgtgactagtttgtctctgaatccctggtacctggaagtggcctgacccccagaaggcactccgatgacgtctgttgaatggatagatgagaatgcacataagaaaaagtgatttttttcctaacaaagtaaaatggcattccacggactttggggaagttggctccttcacttctagagaaaaaaggagaataaggcaggaattcaaaatactcttatgaacagaaaggcaacaggtagagcaggacatggagggattcatgaagggagagaaggaaggcagggaagctgggctgtgcaataagcagcaagcctgggtgttatttcagcctcccgagaacatgccagaatagacattgccattacctccattttcagaggaagaaactaagacaaatgaatcagacagaagacatgatgttcatctcataaatggacatgtggagatttgaacccagctcagctggctttgaattcagaaatctttacccctaagggacatcatgaagcaagacaaagaatgaaatggagggctaggatgatgactggatttcctgctgattgaaggaatgttgaaccaagcacatgtacttcaatcctaaccatacacagggaagttctttctgtatttggaagagctaagcggaagatctcagcactagtcccagcccctgtgtccatgccatttcagcactagataacaagatatatccatgtaggaagatggatgaggaaagcagggtggatctgtctcccccaaaggaaaccacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacacgcttctgtgaagaaaactgatattctgctggggtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgggggtacagaggtgcacaaaacgtgcaaagtgcctgctacagtgatgcttaccctctggtggggagagctgaagttctgggaaagtacagtttgagggaatgcctcatatgcaaaaggccaaccctgggctagatcctactcatgtatgtctcatccagttcctcccaataatcccaagattaggtactccttgcatcaaatcattttaaagaagagaaaattgagtgtattagtccattttcatgctgctgataaagacataactgaaactgggaagaaaaagaggtttaatggacttacagtaccacatggctgggaaggcctcacaatcatggtggaaagcaagaaggtgcaagtcaagtcttacatggatggcagcaggcaaagacagagagcttgtgcaggagaattcctctttttgaaaccattggatctcatgagaccttattcactattgtgagaacagcataagaaagatccacccccatgattcagttacctcccactgggtccctcccacaacatgtgggaattgtgggagttaaaattcaagatgagatttgagtggggacacagccaaaccatatcattgggtctcagagaagtaattgcctcaagaatcacacagctgacaggtaacagagccagaactcaaaccccaggcctcctgatcacagctgccatgttgcacaaccctcatctcagaaggaatcagaatttgtgttcacggttacacgtgttcagggtcacacacttagtgtacgatgtagccggggttaaagctgagatgagccaactctagaccctagtctcttaaccactatagatactgctgtgctagcatacttggaaaccaccatatatgttcttggaaattcaccaagcacattaccatgttaggcagacttattactattctgcagtatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaagacatttaggctgagaagctaattaagaaataacagagaaaactaatgaaacccaaagctgattctctttaaaaaaaaaaaaaaaaaaaaacaaaattgataaacctaggtagactgatcaagaagaaaagagactatcagaaataaagtctggtgcattactacagactttaagatattaaaaggattaaaaaacccttatgcctataaatttgacaacctagatgaaatggacaaattcctggaaagatacaaattaccaaagctttttcaaaaagaaatagaaaccttcaccaaccctgtatcaattaaagaaattgaacccatagtttaaaaccctcccacaaagtaaacttcaggcccagatgtcttctctgctgcactctataaaacatttaaggaaaaaaaaaaaagagtcctacacaaattatttcagaaactagtgttcagaaggcaatacttcccaattcatgttatgaggatagtattaccctgattccaaaaccagaggaagccattataaggaaactctagaccaaccttcctcgcaaacatacatgcaaaagtgccccacaaaatatgagcagatcaaatagaaaaatgtaacaaaaggcaatgcattataaccaagtacgttcacaccatgaaggtaggctgaaatccaaagaacaagaaataaccagattacaaaaaaaaaaaaaataggaagaatgaataagacctaccatttaataaatggcacaacagtgtgactatagtcaataattgaacatttttaaataacaaaaaatatataattggatcgtttgtaacacaaaggataaatgctcaaggggatggagacctcattttccatgatgtgattatttcacattgcatgcctgtattaaaacatctcatgtaccccataaatatatacacctactatgtacccacaaaaaaaataaaattttttttaattttattattattatactttaagttttagggtacatgtgcacaatgtgcaggttagttacatatgtatacatgtgccatgctggtgtgctgcatccattaactcgtcatctagcattagctatatctcctaatgctatccctcccccatccccccaccccacaacagtccccagagtgtgatgttccccttcctgtgtccatgtgttctcattgttattaaataaaaagaattttaaataaaaacagaaataacctgtcaagtgaagaacaacaagaaagttctgggcaaagggagtggcacacgcagaggctacagggtaagaaagagcttggcaaatttgaaaagttgaatggaaaccatttggaatagcatttaacgagttaggggaacgtggtaatggatgagactggagaatagacaaggctagatcacacaggacctcatcaaggtaaatagtttggattttttaataaattctaatggacgctattacatggtttttacctggggaatgtcgtggaactgtttgttttaataaagatttcttaacagaatatggagaagcaagtggcaagggggcaaagtggaagagagataccaatgaggaagctattggagtgatccaggggagtgatggcgccagccaggactggggggtgcatgggcaagggagaaaagtgggtaagtcaagggatatttcaaagataaaaccaacaggatttgctgacagactgcaagtatgagataaggagaaatcttgtagcaggttctggataagtgatcataaatcctactccgttttcctcctgggaatatttagtccataaaaaacttcccaggctccactcctttcacagctcaacacagatgatgtcagtggccttagaagccatatgttgaaggtggcagaaccaaaagatgaaaggagctgagcccctgaatcgtcacttgtcagagggccgccctctgaatacaaacatccacatttgacttcagacgagtaagaagtacatctgtggtggattcagtttctgctattcagggatgtatgtgttaaactaacttttcttaacctaattacttcagacaaaaatcaagaaaaagctagtatatcagctcgaccaattaagtggagctaagaatactcttacttcagctcttaaaagaactgattgaaatgagacagtttggaggctttcaagggatttgttcaattccatttctaaaaggaatctatactgagaaaataacagtaaatataaaggtttatgcacagagatgtttatcagtggcatttatattagcaaaagtttccatgaaaatgaccaaggcacccaacactaagtggttaaataaccaccactatgggcattaaaaattatgcttacagttcccaggcccacagcgtcagcagcagcggcagcagcggcaggcggccgcgcgggtgtttgtcgcttcgcggggccttgcggcagcatggcgaaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctgtggtcaatgatcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctgcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcggcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcaggagagctcaaatttgagaagtggaccatgtcagcccagatcgagggtggcgtccatggcctgcacgcttaccagaagcagctgtactgaggatagcagtggaggatgaggtggtggagggagcataccccagtgtccaccttcgggcacaacctctctccataactgagtggtccacagatttgcactacgggttccccagctcctttccagggagagaggaggagaggtcctgaaggctctgcagcccctcgctgagcatcccctacagagtcgggcctgctccctgggccaggctgcctgggggcgccccccagcccagccagccaggctctcaggccctgcgcctgcctcaggtctttcttgctgcagcatgctccagcatggcccccaccccagggacaggaggccccacctggcttctcctgtagggtacctccctgcccccagcccccccaggaaatggtgctttcctggctctgcctctggctcttcccgggccgctgccccctcagccatgtggcacttctgagctcctgacctaggccaagaggaggtctctgcccccttccccggtcctgggctacccttgggtcctggctccttaggccattcccctgtccctggccccggggaggaggctgccctgctcatggccgcctgcccatcattcgtgactcaccaccgtccccatataccattcctgccctctcctcagctgcagttgaaggctttaactttgcacattttgggatcacagttacatcactgtgtattaaataatcagaataaataaaaattatgcttacagagattttgatagtaagtgaaacatgcagcttatacactactgcatgtataaattgtgtgcaattacaaataggtatggatatatttatatcttatgtacttgtataaatacagatacatacatacacatgcacatcaatgcacacatatatatgcagaaggaaataaatgggaaaatgccattattgtttaatatgtgtgacagcgttattgagttgaaaataaaatacactcagcattatttttaacaaatttaaaagactatttcatgaccttgaggagtagagtcttgaagggcatcttaagatttttaaccttagttgggcatggtggctcacacatgtaatcccagctactcagaaggctagggcagagttcaagaccaacctggataacaaagaccctcgttcttaaaaaaaaaagaaaaaaaaagatttaattagccatgcatggtggtgtgtgcctgtagtgccagctactctggaggctgaggcaagaaaaattgcctgagcctgagttcaacgctgcagtgagctatgatcatgccactgcactccagcctgggcaacagagcaagaccctgcctctaaagacacaaaaatagaaaataaattttaaaaaacaaatccttcataaaaccacacagtgagactgtgctctgcagcaatgccaatgctaaacactcttagaaaagccccacaggggagcctgcttggaaactcaagagagagttgaagaggttttgatccacccaagagattatgtgcgggtaaagccaaaaggaccccagactcgaagatgccagcctgggtgaaatgaaccaaatcaagcaaagcaggcagatgctgtaggccagtcgcccacagaagaatcataacctttcaaagcagattgtgtaaacacaggagagggaggaggaagatgtatcttctgtgtccccagaaacccgcaggcaccggtcccagcgatcccaggaagtgaatagctagtttgttttgggtagctaagaacactgcccactcaaccaaaataagagtgacttcttcaaaaggttatgaacccactgatttctgacagtatttcccaagaaggcaaacagagcccaaagcctgtgcttaaaaagctagtgatctaataaccaaagaatcacaaattaaagtgtcctatatgagccaaataggaacactggcaaaatagagaatttatgcttcatttaatggggcaaagtcacgcccccgatgtgccaggtctgcatgctgttttaaaaattttttgtttagatattttctatgtaaaactaaggttatttcacttaaaattccaattttcagtttcttcctgaaaacatggaagaactgtcaacactggacccacgtccccacatggcattaatccatcaactggcctctttcacttgtttaaaattattctctggttcatttaattttttgagtttgcagcccttgctgtgcatgttccttccctgcttaaaatgtgctgctttcaatgctctgttgcaattgtatataaagtaaaagtaaactagcctggagagacagtcttaagacggctctcctttgtgtagaatacatggactttgttgaccactcttttgcatgatctaagtttttttttttcagcttactttgtaatttccttatggtttcaaaatgctggagaactggtctccaattagtgaagtatttctgggggccttctttaaagttacttgctataccatcaacatagtatttgtatgttttcatttgtaggtagtaggagagatgcttaaacaggaagagacagaagctctccttgttgaccccactcctctcttgtcttagatgccagaaacctatctggaggaggataagcagagcatccatccatgtgcacaccctggggcctgcgcccccccataaatcattatctgaaccaacaggataggctgctgggacacccactctacttatcagagcccagcagttgtgcccaaggcaacagcacctgaattttataattctgcaggtgaaatttagtgcaaaccagatattcctgagacccaacttggcttccgcaactgtattctcaagctgaaaacattttgtgtgaatggggtatgggggcgtggggacactgtttctcagaagccttcattatttcatttctcaagcaaatactggggatggaaatatggagcataattactcaggactttttttttgttttaagaatgaccagaaatagaaccatgaacacttttggtgggaatgtaaattagttcaaccattgtggaagacagtgtagtgattcttctaagatctagaaccagaaataccatttgacccagcaatcccgttacagggtatatacttaaaggaatataaaccattccgtcataaagatacatgcacacgtatgtttattttagcactatccacaatagcaaagacatggaattaacccaaatgcccatcaatgatagactggataaagaaaatgtggtacatacatattatggaatactatccagccataaaaaggaatgagatcacgtcctttgcagggacatggatgaagctggaagccatcatcctcaacaaaccaacacaggaacagaaaaccaaaaaccacatgttctcactcataagtgagagctgaacaatgagaacacatggacacagggaggggaacacacaccagagtctgttggtggtggggaagggagagcatcaggataaatagctaatgcatatggggcttaatacctaggtgataggttgagaggtgcagcaaaccactatggcaaatgtctacctaggtaacaaacctatgttctgtacatgtatcccagaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttggaaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccatatgcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtgactgaaaaaaaaaaaaaaagtagctaagcttactccatgcacaggtgaattcaggacccaaaatctgtcatctggatttcgtgttcctccttcttgctgttctgctgccacacagttggctctagttgttggctccaattcttggctccaagtggaagcaagatggtagcagtgattttattccctacatcttttcaggttcacttttaatagaaaataccaagtcttttcccccaggagctcttatctttagagacgcatattgaaaagtatagagatgaaatgataggatgttgggaatttgctccaaaataatctactgtgggtggcgataaaatgaattaagattgtccatgagttgataaatgctgaagctggatggtgagtataggagagttatctctgcttatgattagagttacctctattttcatgcattttggaaaatcatcataataaaaagttaatttgaaaaaagaatctcttttactcaagtttgaggtaaagtctcatttcacctcactgggtcttcctggaccagataaccatccccgaactgttcacagggaccaggagcatataatgaccacattgttccagcactgaaccatatgctccatctctgcaccaggaggaatctctacaaaaagctcaggggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcacaagtgacttggtctgaacaatgagagggagaccctggtgatgggtgcagagatgagcacatggcactggaccagccaatgataatcttggggcattctctggagcccctcttccttctgaggtggccaagttgaaggatgaacatctgttgtggctggtgttatctttgccatcacttaaggagaatctgccaaagactgagtctgacagaggaaagcggagcccaggtacaggaagacgttctcgaagacattgttatatatctgtattcagccgtgctggaagccagataccctgaactttttagttacctgatcaaataaatgttcctgtttggcttcaggttctcatttagactcctgtcacttatatctctggctaataaagggaactatggtcacccccaccccaccccacgcagcaattgtagtttttcccgccccgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagacagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaatggaagatcagcataaacaaagtcacattcaggccaggactcttaagaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccatcatcctttgaattacgaagctaagggaaaaaaagcccattggctttaaaacccagcagaattcagtaggaggaggaagatggagaaagttataaagtaatcaagttgggtgggaacctcaggttagatcctcattacacttagaatgagcgttacccatttgacacaggtggatatctttgctgttactcaaagccaagaggaaggtattttccagctttatttgatgagttgttttcatgcttaatattttccagaaatctgttaattcatacaggtaagagactgtgccttagtcatctctgtagcctccacagcccttcataaacagcagattcaaacaaacaaaagcttcattcaagaaaggaaggaaggcggctttttgtctagccccgtggttctcaacagggaaagattattttttaactttcattttaggttcaggggtacatgtgcaggttatataggtaaactgtgtgtcacagggatttggtacacacatttggtacagattattttgtcacacaggtaatatgcacatagtacctgacaggtagttttttatcctctccctcctcccaccctccgccctcgattagaactatttgtctgttgttcccctccctatgtccctgtgttcgcactgtttagctcccacttataagtaagaacatgtagtatttggttttctgttcctgcattagtttgctaaggataatggcctctggctccatccatgttgctgcaaagtacatgagttcattctttttatggctatgtagtactccatgctgtatatgtaccagattttctttatccagtctaccattgatgggcgtttaggtggattccatgtatttgctattgtgaatagggctgcagaatacatatgtatgcatatatctttatataattatttatattcctttggggatatactccataatgagactgctgggttgattgataattctgttttaagttcttttaggaatcatcacactgctttccacaatggctgaacaaatttacattcaactgggggagatttttaccaccaggaaatgtttgtctatggctggagacatttgttgtcacaactatggactgctacctgcatttagtgggtagagtccagggatgttgctatatatcttacaatgcacagaacagcccctcccacagcaaagaattctcctgctcaaaatgtccatagtgccaaggttaaatcttgatattataacctaaggttcccatcccaacttgaccaattaatcattttataactttctccgttctcctatttaacctactgggctttaaagccagtggccctttttcttagcttcctcattcatgaaacagttttctggggaggccctagaattttacctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggaaagagacccactccagttagttcaagagaaactgtttattgtaaggacacatgcagattgctaccagaagccttcatattctctccccactcccctgccccatggtcccctatttccactcccctccagtcatccccacactgtcctcctcccacagctgtcccctgatccttcctaacttcagctcattgtggcatcttttcagcccctgtatccacgatgctaactgaaaaatcctattctatttctaattcaaaagcccacatttaagctcatcctttcaaacccagccacagacgtcaaatttcagactgaggactggatatactttcatcggtccaacactcttggtcaaagcagcaatccacagcaagaagggtggggcaaccacaaagattggcatctctgctacactgtatcacacacactcctacccctgactccgagtgacatcaaccacagacagttacattgagctacaggaaggattaaaccacttccaagacccaggaggtcccctaatcattttgccccatgtcttggctcacacccctggaaacactgggggaaagtcacctaccttgtttggggacacctttttagaggataactcttggtcctcaagcttagaagctgttatgaggaagacgttggggcttttcagaataacatccgaagattaccccacagataccttctcctctggaatcgctctcaacagtgtcaggcagagccccgggagcccacacatctttctctgtgttcttgtgaccatggaaatcaggcaggtctcaagaaacaaagtcacaaaggcatgagctcatcatctattttcataacactaatgcaagagacctccaacacaagcaaagcaaaggcaccgactgggtgcagccacatatcatgagtttccaggccattctgcctgagttgagatcattatgctgcttctttcattgcacaggaacgtgggggttttctctaaactatgactcatagcaaagcatacaggcaatcatgtagagaaacctgttctccccaggaaaggagggtgagcaaatgctaaaagttttgatactttaatatagcactggccttggctaattttacttaatatgaaagatttcaaataatggaaacactgacaggcaaaaacattaaaagtttgcataaaatctcaaaaaaccctgcaaacaagagagaagcatggtctaattaaaataaaggaaaagattgctactgggttcctgaatactcttttcacaaaggcttcacgtcagatgaacttcaagcaccaagcagcagggatcccactgaagtttattcagcgcccttctgggcactaccagctgtgaaactggtaacctattgacaaataggttatttttccagctgcacccatattcaagagcttgaccagcaaagtcccctgataatatttggccatgagtcagaatgtattaggcaccttctgtagccagagccaaaaaaactctggctacaggagaaacctggcactgtgcacaagatccccttttttagcatcagctgtcccctttgcagtttgttaaagctggaggagttttaatccaagtgaactctctttcaggaggcttcggggtaaggaagctacaaaagcggggaggtaggggcacggctgcaaagtgatgaacattgcagcaggttcggctattcagaatgagctattttctcccaaatcctgtaattgcctggagcacgtgatctttttgaaggtcattagaggcatgcggctgtcagatctctcccagaaagtttcgctttgattagttagttcctgatgcttatttcctaaaaggctctttttgtcccccacccccccaaaaaatggggagcattaaaattttaaaaaaggaattagatgaatatcctgctaaatgtaacttggcaagatgaaaggaagtagcaaagaaacatgaaaagggtgcagaccttcttgggccccctgctggagagccaacctgagggaaattgacgcacgatcagcatattccttccccaaaatgaggcgactcggaaatacacaatatcaatcatcatctatgcaaccactcattattttgactcaaacagaacgacatacatcattggtaaagcccacgtggacatttccaggtccctggggcatttataagctgggaaaggttaaaaaataaaataaaattctcttttttaaggattccgatgtctaagaaagcagccatgaggacctaataaagaactagagctgaataagttgtccagtgactatgatcaaatatacagctagcaatggcaatgtttcacatcaaagaagaaaatcaaagttttttcccagcacagggagatggggccgatctctcttggatcaaaagtcctttttgtcctctcacatttgcagatgtgtaaattccaggcagatctaatgaaggagttaccttttcaatccctagattgtgtttgccaaaacttcccttgcaatagggacactccagcaaccctggctcggggctccctgcgtacttagatgtaatactatgtcaacaacatcctgcaggctgaagcagcctcttttttttaaagccttggatcaactatgcaagctcaacttgcttttatttttgttgaaaatactaaattcatttgtcatcactaattccctcaagcaaaggaacagctcctcgttgatgccatagtttgcaagatactgaagtcgcacgttgtttctaagaacactgatgctctaaatctccagcttttgacttcaggaaaatggcacttactttatattcatagaatttctggggcagttcttctcaaactttaacatgcacgtgaatcgccgagggatcttgttaagaggcagattctagctcggtcagtctggatgggacctgagattctgcattcaggttcccagaggatgtcaaagctgctggtgcatggaccacactttgaatgatgagatctgtttagctggttggtaggtacctggtggctgagctttcaaactctgtaatcagactacctgggtttgcatccagcctccactgtttaccctttcttactgtgtgcctcagcttccacatttgcagaatagtgctcaaaataacagtacaaatagagctgctccgtgggttacagaaagctatatgtataaatcactcggcacagtgtatggcacatgagcactcaagaggtgagctgtttctgccctggtgtaatcatccctcacagagcccttgttcccaccttctttccaggcagtagaaagccagaatagtctccagagacagatgaagtgaaattgcaagcttctgactctcacaactcaacccatcagcttaggttgttaaaaaagcgaggtattgcagtgcactatattgtcatagtctgagaagggccgtgtgcgtgcccttgtgtgttccaaaacctaggccacgatgtatagggaaaaaagagcacaggtcaggtggcccagggagcaaactgacctgtgagatccttcgtttgcttacttacaacattgggataataaaacctaccatgtagggatactatgaagatcagggatcatgtatgcaaagtgcctgccctgtatgcagtagatgctcaataactggaggctgttatgcttgtaatcaaaatcctatcctcccaagagcaaacaggagaagaagccaacataactggcaacttagccttgataactctttgtttatccgggcaagcggaaaagggcaggattccttggtgcttgggtagagagcttttccatagcctcagatacagacaggggcactgaaattatggggtacaagaggtttttccaggtggtccaggtgagacggagctgggagatggcagggaaagatacagtcacaattgataactagagagctatccattcattcattcattcatgatatttataagttggcccgtgtgtcaggtgttgtacaagacagagcagaggccccactctcaaggagcaaccatttcacagaagagacagaaacatgtaaatgaacacatacaagttaaagttgtggtacagctaatgacatgagggctcctatggaaaaggttagcaggactgtcacgaagccctctcaaaggaaatgccccaaaagccaagttgtgaagaagtcatcgtcaaccagtgcagaatagtgggaagagcattccaggcatagggaaccatgaggacaaagcccctagggttggaaagaacaaggaggaaaatgacagcaaacaaagccccaaaaaagcacgtagtgcccaaatcatgcagggtctcttcataggccatggtgaggatgttggattttattccaaaggctacaagatgccatgaaagggttttaaatctgtcttacaaaaccataaatttcacactgcagcaatcaagtcccacaatgtcctgaaactatggagtcagaacttgacctcttgacgccttctacttcttactagagattcaaggtctttgaccctggtgacacaacaccagtacgggattttttcaaactttttgcatttattgtcgaagaagcaggggcagcaaagaatatttggctttccctggaagtcccaagggatgctggacagaacaaccccaagtggaaagacccttgttaggagaagtcgagtaaatacactagtgagtagaccattcctccactacaagctcagcactcccaaggaataagtaaatccctacttaaattgcctgggaggcctccctcaattacacaaatctaagacatgacagggtacagcagagattctcctacagcaagtctgaaggctgagagcaaagcaatggagctaaggcatcatcctcatactgctcatggtgggaggaaaaaaaaaaaaaaaaagactgttccgagtctcccctccctggctgttttgctaagccccaggcctacaggaggctggatggcccaggggaagaggctgccttgcctaccctgggaaagtggatggagggtagcttcttcctctgccaagaaaatcaggcgtcctacagggagagagagctgggggtaaaggctgggtgggaggatgcttaagggccagtctttccccaaactcagctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatatatttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagccagtttcattaccgtatttcaaatattttgcagtattggcagggtttactattttcttgggcatctattagccattgagtttttattctctaatcacatgttactcatttctcttccatttttcttttagggtgttttgtctttttcttaatttgtaagtcatctttgtgcgttaaagatagtaaccctttggcacgtatcaccaacgtttttccctaccatttgttggtttctgttaattttctttatgttattgctggaactccctgaaacgaccacaaagcaaccatttgattctgccaaaaatattgtctttgaaatatggtttctagaacgtctgtgagtcacctgctcacatgtccaagatgtctcagaaatccttctgcttttataaaccttgtcttttggcctacagcaccagtctacactttttaccagctctgaggaccttctgagtcacactctgaagtcctgacctcaccataaacaaagagccttttctgggggagttggagctgccctaagccagtgaaagccaatgctcacacgcttgccctatccaactgctttcattagctccattctttttagtctaaaagccttcctgacagcaacaggggccaagaatttctctcatgaaccccattttcttgatttcaaaatccacttgccttgggagaaacgcttgaacctgggaggtagagattgcagtgagcagagatcgtgccactccactccagcctggcaacagagattcagtcttgaaaaaaaaaaaaatccacctgccttggtacaagatgggaaagtctttgggtgtttattggctgtatgttcaagatgaatcacctgtgagctgtggcatccatgaaaatgtggagctccttaccatcctcaagaactttctcaccactcaacctctgcatgtgatattcctccacctaaacactacctccctacccccatactccaccctggttggccaacttctaatcatttttccaatcttagcctaactaccaccgccctgggaggtcttcaccagcaactgtgccaggcacccttgtgcaccaagagcctttagtatcatttctagcatcatggtatatttatatataagaataattgcctgtttatctgtctccccagcctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccattgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttgcagctacacacttaaggacattctgatggaaggagctgtaatattaacctatctgggaagtgtgaactgtaaagaagaggccattacagaatgttgagattggccaaaccaccactgtagatgctccattcactggaaccagccttggaatgcagagggctcctgccaccccactcttctaggctagaggtgggcagcaccctccaggcaagagcatgaatcatgtgtgcctgcttgctgctccccctctctccaacagatgactgggcaaaaatagaagagaatccctcctttataaatatctttacatgctaaatgtctctataaagcaccatgcgccaagctaggctgctaagaaacagatgcaaaacagatgcaaagatccatgagatagctgagaagttaaagaattttaattcaacaaaaggcaagaaaagtttcttaggagcataatacagtcaagggaggcctgatgcaactggagagtcatagaaattctggctcccagctattaacaatagtatttcttaccatggcagtttcaatgcacatatgtgcacgagtgtgtctgtgcatacctgagcacgctcttatttcatccccgtaaccaatctttattcatttaacagatatttattaagcacctactatgtgcatcacttttttttttaagcacctactacgtgcgtgacttacttttttaaaacagggtctcgctctgttgcccaggctggaatgcagtggcacgatcagagctcactgcagcctcaaatttctgggctcaagtgatcgtcctacctcagcttcctatgtagctgggactgcaggtgtaagccatgacacctggtgaagtcattttagtttttagtagagacaaagtctctctgtgttgcccaggctggtgataactctcttaagatatagaaatgactaatgtccctgctttcaaaggacacatgctttaatgggaggagtttgattaaaaaaaaaacaaaacactaaccatataatacttagatagagctaagctataggagaaaatgaagctgagtaatgggctaatggctagagtggaggctacttgaacttggatgatcatgaacagcctgtcacagtcagcaatgtttgagacgaaacttgaatggtgagaacaagacaaccacagaaaggtccaggggaagaaattcccaagcaaacggaacaacaagtgcaaaggtgagtgtgaggaatgttccagaaagataaaggaccaagggaaaagagagcaggatttggtctgagatataagcaggagattatggtgctccttctaggccacagcaagcaattgattttaattctaggtaaaatggaaagctggaggaagattttaataaagatgcatgtgattcaagatatgggttttgtcatcgttcttactcactcgaccagcgaggtcatgcattgatcataggatgtcaaagctggaagaagataccagtttagaagatgctgctgtcactgaatgcagatttcataaggagttgcagtgaaggtagaagcatgtttcatggatctgtgttaagggcagagctagaagcccttgctgatggtttctacatagcaggtaagagggagagagaaatcaaaggtgacttgtaggtttgtagtttgaacagctagatggaaaatgaggtcatttactaagacaagaaagtaagaaggagagataggtatggggacatgctaaagacaatgagactcagaaaagccaagagactcattcaaggttacatggctgggaaatgatagaggcagacttggaacgctggtccctgggactccacggcagggttcaaatggtaaagcaagctgaatttccaggccaggttcagggaaacattgaggggaaaatcaaatcagtaatccaggcaaattcagggcataccacgtggctgatctattttcagcatccactcttgtgaaggctacttgtagaatcttagaattaatagaattttcgagctgagcagatctttgggctcaaaagggcatctgtgcctttgcaaacatgattcaccgaacatcccctgagtaggcagatgggtcaggctgctgagtagactttaaatggagctccggacacagacccatcttccaagccatcctattcactttctccccactgtcaaaaggaacaggacattatataaaccttctgaaatgccaaaaggaggaattctatatttaactcccctcccagcatccaaacatcacatgatggaatgttgaggatctaattcaacaatgttgagtaacagggatataacccaggggactctctctctccttctcgcttctcctgcaacttctcgtctccagccacccactgtcatgtcttcattaagggagttcgggagcagcctgactcaagcaggtccccaggaaagtaaacagctgggggagtaaaatggattgtgctaacatataatccatagctgccagggagctggaactcagagccaaacacagactcatctcttcagctatcctgagaagtgtggggactgaggactaagagggacagaggcagcaatataaaaaccagtgccctcaaggttcaggaggcaaatgaaatggaacttaagcttctgcatctctgcagtcgggacttttgttagaaaagcacttaaaaaattcaaggcacatccacaagatttcaagagctggcatgatggaaaatagcggcaggggctgatcaagatggcatggagtgaggcttctgaaaacacttattgaccagcttgcatgctgtgggtgatcgataaatattaaacaccgaggctagtggagaacaggttttaatgaggcccagaacagcatgtagagtgggctgtagtagtgaggggccatggagatgctaagcaaccagtctcatgcctgcaggtcccccatgtccatgcttctccctaggctgttctcagttacaaagacaaagcaaaccaactcggggggaaattcatcgggaagttggaagctaaagggtccctcctagcatggccaaggcctgccgctccagtctcttctcaccacttatcccattttttttttttttaatgctcagggtataacaataaataagagagggacagagagcacctctgctctcggagtttccaggctactgagagaggcttcaaatgcattgacaagactagagtaggaaagtaccttctgtgataggccctcagagaaagggcgtctgtttcagccaagaaggtcagggaagacttcctgggagacatggcttttgaatgggattagccagtttaagaggtggggaagaacatttcataggcaatggcctgagtgcctgctgttctttttgcttgtaacacacttgtgcccctgacccaccatggatcttgtattctcttcactaatatccctctgcctagagtggcaaaacaggaagagtaattcgccattattattagcatgttattattgttattattactactactgttattattttacttatgagcgcttatgatgtgtcaggcactgcactaagcattttaccaccattattctcctctaagctccatatccctaaaaaaaagtattataatccccatttataagtaaggaaactgaggttcagagatgtgaaatagtctgggcttggtggctcgcgcctgtaatcccagcactttgggagactcaggcaggcagatcacttgaagtcaggaattcaaggccagcctggccaacatagtgaaatcccatctcttctaaaaatacaaaaattagccgggcgtggtggtgcatgcctgtaatcctagctactcaggaacctgaggcaggagaatcgcttgaacccgggaggcagaggttgcagcgagctgagattgtgccactgcactccagcctgggcaacagaatgagcagaacaagacaccgtctcaaaaaaaaaaaaaaaaaagatgtgaaataacttgtccaaagtaaactcagccagtaatgggtggcaaagctggatttggggccatgcaacatgtctccagtgcacctaaacaggtgctataccacttaccactaggtcatcctacgtcaaatgtaaagccacacattgagctatgtcgtgatggctttctgacctaactcctcatgtcccttgacatttatcatgcaagagctagtccataggcattggaatcattcgggcatggggttaaatcccagagccaccactaactagatctgtcattttaagcaagctatctgaactttcattgcctcggtttccacaaccacaaaatgggaatttagtacgtatgtcctaaaggactgcagaaagaagcaaaataatacgtctaagcagtgtagcagaagacctggcacttaacagattataagtttcccattgctgctgtaacaaattgccataaagttagtggcttagagtgatgtaaaatgtattaaagtcctggaggtcagaaacctaaaatggaccagcaggccttcctagtgcttccttctaaggctttagaggagaatccatttcttaccttttccagtttgtagagtctgcccacattccttagctcatggccacatcactctaactctgtttccatggtcacatctccttctctgactcttccatgcccgcctcttataagtacagtcacaattatattgggcccaccagataattttggatgaggctctcatctcaagatggatccataacttaatcacatcttcaaaatcccttttgccataaatcataacatttatacaggagtcagagtttagaaggtgaacatctttgagaggtcgtagttctgcctgccaggccaccatcttgctccgaaagattcactccatctccccaaaactaactcacgatagtgtcaaagtccaaaattttcatcaaaatctcatcagaccaggcacagtgactcatgcctgtaatcccagcattttgggaggccaaggcgggtggatcacctgaggtcaggagttcgagaccagcctggccaacatgatgaaaccagtctctactaaaaatacaaaaattagccaggcacggtgctgtgcacccataatcccagctactctgaaggctgaggcacgagaagcgcttgaacccgggaggtggaggttgcagtgagccaatatcatgccactgcactccagcctgggttgacagagtgagattcagtctcaaaaaaaataataattataaataaataaataaatctcatgagctcagatgtctaaaatcttatctcaatcacctaagtcaagtacttataagaatctgagcatgatccctcctgggtcaaagtttctctccaactgtggacctgtaaaactagaaaacggattatctgctccccagatgcaattgtggaacaggcatgggatatcagttacaggggtttttgattaaaaaaggaatcaatgaaaagaaaaaacaagttaccacatccaaacaattttggaattcagttaggcagtccggatgcagtggctaatccctgtaatcctaacactatgggaggccaaggtggttggaatgcttgagcccagacattggagaccaacctggacaacgtggtgaaaccccacctctgaaaaagaaaaaaaaaatacaaaaacagattagctgggtatggtggtgcatgcctgtagtccaacctactcaggaggctgaggtgggagaatcacttgagaccaggaagtcgaaggtgcagtgagtgatcacatcaccacactccagtctggccttcagggtgagacactgtttccagaaaaaaaaaaaaaaaaaaaaaatggagaggagagattcagttaggcaaacattaggcttcaaagcctagaaataatcctctcccatctctgtcctttgagcttgaggctctaccctctgagtaaccagtcctttctcatgaagggtaatatgtgtttccagcctaagagttttaaccgtcatttcctgcctgtagaatttggggagtatatcataggtgataattgaacaatgagaacacttggacagaaggcggggaatatcacacaccggggcctgtcagggggtagggggctgggggagggatagcattaggagaaatacttaatgtaaatgatgagttgatgggtgcagcaaaccaacaggggacatgtatacctatgtaacaaacctgcacattgtgcacatgtaccctagaacttcgagtataataataataaaaaaaaaatttagggagtgtaatggccttccttcattttatcttctctgttcccttctgtccaaattgccaatgtttatgctggtaggaaatttcaaaaaccttatgggtctcctgagtatgtcatggggattcactccatcagacaaaaaatggttcttcacagttctttcctagataatcctaatatctattctttgcttctgatttgatggccaaggggtacatgagtctcatacctaatctcttcaaagagcactctgtgtggctgaatactgggactttttatctttccaacgaactagcaaaaaaaaactgttcagccataccctttcctaacatgctttcctgatagtaaatctcctaattttagcatcttttgcaatccagataggctgagaatttcccaagtcatcaaatcttgctttctttttgcttaacagttcttgcttcaatctctttcctctcacattttactaaaaggagcaagaagaaaccaggctgccccttcaacactttaccaagttcattgcttgcaagttcagatttccacacaactgtagcatataattcagataaatgctctgccactatataacaaggatgtcctttcctccagttttcaataacatttccttcgtaggtagccctccctggtaatgcttttaacgtccatatttccaccaaaagtctgttcatgatgatttaggtagtctctaaaatgatgtatgccttctctaacatgtttcttacttctgagtccccagaaacagaactgttagcattcgtatttccactcacagtctgttgaaggatgtctagtctttttctctgatgtgtctccaaattattctagcctctgcccaacacacaattccaaggccactgccactttttaaggtatttgttacaacagagccctattcttggcaccaaaatctgtattattgagggttcaattaaaggaacagatgagcgggagacatatattaagaaatacatgacaaggaattggcttacatgattgtggggaatgggtaggtaagtccaatatccacagggcaggctggaacttctgggcatgagctaaaccttctctcctcaggtggaatttactcttcagagaagcctcagctctactcttaaggcatctgactgattgaatcaggcccacccagattatctaagataacctcccttaaagtcaactgattataagctttaatcacacctacaaaacaccttcacaacccacctacattagagtttgactgagtacagactgtagccccatccaagttgacacagaactgacagttgttgcattcatcatactccgtccctaacactcaagacagcttctcacgcattcctctatctcctcccctggggccaaggtccagataagcacatgtaagttaagtgagcaagtctaaaagcagatgtgcttatcctttcaatcactctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaaaaacttcaaggaggagattcatttgcaactaggtgctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctgtcagtggaaatgtcttgaaagaataagttcactccaccttcacaaggatggtaatgatgatgatgtttatagcagctaccatttatgggggaactgaccttgggcctcacgactgtgctaagcacttaacatacaatgtttcgttttatcattattatgacctgaggccctgaaaaagaatttgagctcccagtggtttgagaaatgatcccaggaaacactggtaagaggaaagagaagtgagacagggaagtaaaaggaaacaataaatggtaaattttaaattaagtgactgcttaaggcaactgggccttaagatcactagagacatctgggatatagcatgaaatatctactctacatcacagttatcctgcctacaagacaacggactggagtgcttatccacaaatccctaccgttggctgcttccagcaccttcactccccctgcaggtgggctaaacctgcttccaaagccagaaaagacagagtcggaggggttcacagtgagcaagcttcagtatatggaggcaaggactgggggcatatgggaaagccccaacagcacatgctacataaccctaataagtaggtggtaccaccctcatttaaaaggagaacaaaaatgaggctcagagaagataaagtaacttgcttaaatgaggaggctggattgaaagcaggcctgactctaaagtcacattcttgccccctacacatgctgacaggtgttcctattttctccatcttagtttgagccatatcacccacacctggaggtctgcaatgacctaatgctttcacctgcctccagtccttcctgcacactatggacaatttcatttcccttccttagctacttacaaaacggaggacgaagttcaaactccatattcaggcactcgattattcccgtcagctggctgtatggccactgtatgccttcctgccccagccctggcctacatttccttaattcaactcacgtgccatttttcttcttttcaataaaaattcactgtgcacctattctgtgtgagacactatagtttcctcctctgtaaaatgggggtaattgtagggttaagagcattaaatgagagagtgtgacatgcttagcacaaagtaagggctgaagcaatgcaagcccgcattatgagctcacccaagagtcatgactttatcctcagagcctgggatgcaccacatagtacttgtcataaactcctagatactgaacatgatctctctgcctctgaggggccagctccttgagataatgggctgtacagtctgggatgacagaaagaaccttgggcttatagccagaagccagattccaaatttggattttaccaatccctggccatgagactctgaccatatgaatccactcctagaccctagttctgtcatcaccaaggtgggcatggcactttcctcttggcattagtagaaattaaaggctctgtagataatgcttcatgaaaagtgggctgtttccatcaagcctaaatcatataagtgtgtgagatggttaacactgaagactcagaagtcagagagggctgagtttgaaaccacattcgatcactattcaactgtgagactgtattggttcattttcacaatgtaaagaactatctgagactgggtaatttataaggaacagaggtttaattgactcaccgcttggcatggctggggaaggagacctcaggaaacttacaatcatggtggaagacgaagaggaagcgaggaacatctcacacagcggaaggatggggatgggtagaaaagaagcaattgacacacacttttaaaccatcagatctcgtgagaactcgcttactatcacgagaacagcaaggggaaaatccgcccccgttatccaatcacctcccaccaggcccctccctgacacgtggggattacaatttgagatgagatttgggtggggacgcagagccaaaccatatcagagacactgtgcactctgtttccttctatgagcctcagttttcccatctgtcaagcaggggtaagaatagtgccagcatcccagacttactgtgaggattaaatgagatatttaaagtacctggcatagtttcttgcacataataaaatttcaatacatgccaactattatcattatcattattactatgccatcattatcagaatgttttgaatatagaattgcttgaggatagtttattgaatgatgagtgaattaagtgctgagagaacatcatccactaaggtctgagtacctagatttcagaattcttggtatgggagttctccagtggggaaacaaaaagccttgcaattaagaaaactgaaaaagaacagaacaggcttggcccagttgccgaagaccagtcgtgtgtgaaatgcctcagaacaccggatggagacagcacggatcaagccaagtaaaaattgagagcatgaaacagacagccctggaggcctggaatctgctgaggccatttcttcctgagacctaggggtggaagcttgggggtcaagtctgctttgagaggcaagatctcaggctgtgtgcagaacacttttgcacctcgtgtctcagtgatgggaggtcagggtgagcttccccaccaaaccccaacaggtgtttattataccctgtggggaggcagggagaggagagggaaatgtctcttctgaagaggcctagggcaagaggggcagctgaaagcctcattacaatgaaaacagaaaatagatcaaattaaaagccaattaaaaacaaaagccaatctgcttccattgttaaaatccagattccagttgtctgtctgtagggtttggcctgtgcaatttaaacaagacatcccaggggatacagatgtggctgctcacacttagagtagtaaggccttggatgttacttagtccagtgtttccagactttctttacgataagaatcacctggggataccttgttaaaaaggcaagtatgcaaccttacccaaacatactgaatcaaagtggggtggggggaatacccaagaggttgtaagtttaaagagctcacaggttatttttaatatcagagaggtttaggaaacactgatttggtctgtatcaggtgcagcaaattcaaatatgtgcagaacccagagagatgagataaataatttttttttttgaagggagtctcactctatcccccaggctggagcacagtggcgcaatcttggctccctgcaacctccgcctcccaggttaaagtgatcctcatgcctcagtctccagagtagctgggattacaggcacctgagatccagtaaatgagaaataggaatctatagccctgctgaacatttcataaggcctggcataattcaaattctgccctgtaatcaggctgtcccaggcaacacaggcaagattaaagaaatatttaagtttatttgctttgggctggaatatatataactcagtgtagttccactggttaccttatgttctgttgatctgcatttctaagtggcaattgattgtatgctgttaattcatttttttaaataaaatcgattagtacttaattaatgtattttgttttgccggcaaaacacacagtataccatgacgataaaaagccgcaggataagaagagtccctggtgaagaaaaggtgaggaacttcagaagaattcaggcccaaatctctttcaaagatttggaaactgggttcccaaaaagagagttgacacatccagggtcggagtgatagtgacacagtcaagactagaatccaagtcttccctgactctcaatctagtaaatttttctattataattcaaataggtagcctatgggagaatgagatctttggttttctctagtccagaaaacactctttcttctggcacttttggggaaccaactgtccccacttttcattccatgtagctcaagtggggcaacttcagcatctccagctctcaggatatgcacatgaccagcctggtcagtcagtgtattcctatcctgaacaatgtgattggttgatttatgggcaagtgaggaagaggagtccaatcagagttagccctgggacttctgatgaagcgaccaggaagtggactctgcactctgtttcccctaagtcacttaactgacagaataaagatgcaacacttctgctagtgactgtcttgccacactgggagttggggtggggagacattccctgaataaagtcaatacaggctgggtgtggtggctcctgcctgtaatcccagaaattttggaggccaaggtgggaggactgcttgagcccaggagtttgagaccagcctgggcaacatagtgagaccccatctcttcaaaaataaaaataagcaaccaggcatggtggtatgcacctgtagtccaagctactcaggaggctgaggtgggaggatcgcttgaaccccggagggtgaggctggagtgagccagatcgtgccactgcactccatcttaggagacagagcaagacactgtctcaaaaaaataaaaaataggccaggcacagtggctcactcctgtaatcccagcactttgggaggataaggtgggcggatcatgaggtcaggagttcgagaccaacgtggcaaatatggtgaaaccctgtctctaataaaaatacaaaaatagccaggcatggtggtatgtgcctgtagtcccagctactcaggaggctaaggcaaaagtattgcttgagcccgggaggcagaggttgcagtgagccgagatcatgccgctgcactccagcctgggcaacagagcgagactccatctaaaaaaatgaaataaaataaaataaaaacacaatgaatacagagaagaatcaaggggaaaagcaggagagaccaaatccaaatgacacctggatctagccaggctggaagattcctgctcttttcagttacatcacccaccttgtctgacttcctacagctgccattggttaaaaacaaccataatgccagaccttttcatatatttctgttgtaaaaattgagattttacagatgatgttcatttacactatggcatgccatcctcagggcacctctgtgaggtaaataggccaagggctattttccacattttacaaatgagataccagagctcagaagggaatgatgcattgccaaaggtcacactgctcaccaacagcaggacagggacaataaatctggtcttatgactccagctgagagtgctttccaccacagcactatgtctaacctggtggaaatgcagcaacttcaatcctcacctgcctcaacttaggagaagcctctgcctctcctatcacactcaacagggatatgtttcttgaggctgatgccagctcaaagcttcattgcaaaattcttccaggctacctgttctgagttataggaaatatcccaaagcgcccatgtcctaccattccagggtacaaaagagcacgaacccacaagaagatattggaagatttactgagccacagggaaatgaggaaatgagagcaaagtaaggaagttatataagggtcacacacacacacactcaaaaaacccagggttaaggttagctgcagcacacagagacttgcagcttacatttagggagacgaataagtttaaagaacagataaattaaaaagactaaggctccatacacgtcagagccctgacttaacctcaaccatccaggctcaagttaaaccaacgaaagtgaccaggcatagtggctcatgcctgtaatcccaacactttgggaggtcaaggcaggaggatcaaggccacaagttcaagaccagcctgggcaacacagcaagaccctgtctctacaaaacatttaaaaattacccgggcatggtggtgtgcggtggtgagtatagtctctgctactcaggaggctgaagagggaagattgcttgagcccaggagttcaaggctgcagtgagctgagatcatgccactgtactctagtatgggcaatagagcaagactctgtctctaaaaacacaaacaaatttaaaccaaccaaagacaccctaaccctctcccatttccacctagcttctctcaagtccctgtctctgaatcagaccctcttgctatgatctctctcagtcacattcccatgtaaaattctcgggtctcatcccttttccaattaggtatttaatacaactctgatcctggtgccaccacataataatttacacagaacacttaattagcttcttagataaaaataacatgtaatttgtttggtaattatatgtttccacaactgctgaaagcaactcattataggaatttggtatacttaggatagattaccttaattctattttctgtttatccaattagatttgccggtcttaattgtactataaattgtgttgagctggtgaagatgactatgaagttgttgttccttcagatttcatggttggtatgcatgtcgctggtgtttgctccaggcactgactaactctgtctgggttgtgaaaacaaggacactgtaagacctttcatacctttcaaagaagaaagtggacaacgccttccgctaagggcctccttaacgtggtgtattccagtgtgtggtatactgatggtgtacaagatcattttagatggtgcagggatacattttcctcttaaattttcaaaaattcaggagccattctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaataataaaattgtatttatagtcaatacaggagttcttttaatatacttactgaaactttaaattaaaatgatataagttctgagatttgcattaaaataatcagggggttggtaaggtattagggaggagggagtattaagaaaacaagattgggcagggtgcgatggctcatgcctttaatctcagcattttgggagaccaaggcaagtggatctcttgagcccaggagtttgagaccagcctgggcaaaatggtgaaaccccatctctactaaaaaacacaaaaatgagccaggcatggtggcacacacctgtagtaccaactactagggaggctgaggcaggaggattgcttgagctcaggagatggaggttacagtgagccactatcacgccactgtattccagcctgggcaacagagtgagactctgtctcaaaaaaaaattttttttttaaataagattgtccccaacatggctctcttggataatgccataatgaacatgagtgaacatgagggtacagatatttctttgagatcctgatttcaattctttgggatatgtacccagaagtgggattgctggatcataagatagttccattacgctggtgctattacttttaattgcaaaaaccacaattacttttgcaccaaccgataataaaaatttaaaaatttttcgaggagccgccatactgtttttcatatcagctgcattattttacattagcaccaacagtgtacaagggttccaatgtccccacatccttgccaacacttgttatctttggtcatttttataatagccatcctaacaggtgtgagataatttcacagtcactcgttgtggttttgtgttgcatctccctgatgattaatgatgttgagaacctttttaatgcctgttggccatttgcatgtcttctttgaagaatcatatatttcaagtcctttgtccattttttaattgtccatttaataattttcactactgagtcataggaatttcttatatattttggatattagccccttatcagatatataatttgcaaatattttctcccattctataggataccttttcattctgttgattgtttcctttgcttcgcagaagtttcattgcagcattattcagaacagccaagatacggaaataacctaaatgtccatcaagagatgaatggagcctggccaacatggtgaaacctggtctctactaaaagtgcaaaaatgagccaggtgtggtggcacacccctgtaatcccaactactcaggaggctgaggtgggagaattgcttgtacccaggaggcggagactgcagtgagctgagatcgtgccactgtactccagcctgggcgacagagcaagaccctgtctcaaaaaaaaaaaaaaaaaaaagagagatgaatgaataaagaaaatgtgacatatttatacaatggaaaattgttcaacctaaaaaaaaaaagaaaaaaaagtccgctatttgcagtaacatggaaaaacctggaccattctgctatgtgaaataagaccattacagaggacaaaaactgcatgattccacccatacaggatatctaaaatagactcatagaagcagagaatagaatggtggttgccaagggttgggggcatagggaaatggggagctgctgttcaataaagttttagttatgcaggatgaataagttctggagatctgctggacaacatagtgtctatagttaacaaactgtattctgcccttaaaatgttcttaagagagatctcatctcaggtgttctcactacaacaacaacaaaaacaaaacaaagagacacaaggaaactgttgaagtgaaagatatatctattaccttgattgtggccatggtttcacaggcacatgcatacatccaaactcatcaaattatgtatattaaacacacgcagtttttaatattatttagatgtcaatgcagctgtttttaaaaaaaaaaaattgaccatgagttgaagctgaattgagggtacatgagtgttcattacacattctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttctaataaaactttatttacaaagacaggtggcaggccatagtttatagatccgtaaagtaggtgataccttgatatggcaaaatccaggaaggtgatacaggaaagactgaaataagaacagcattcagttactgggaccctgagtctcctctctttagagaaattaataaattcttatgaattcagtcttactcagagacagctataggacacccttggtgccaggtagaaacacaaataaaaggaagacaggaacaagatgggagcacggatgcatatccactcatccatttattcaacattttttttttgagatggagtctcgctctgtcgcccagactggagtgcagtggtgcgatctcggctcactgcaacctccacctcccgggttcaagcaattctcctgcctcagcctcctgagtagctgggattacaggcgtgtgctaccacgcccgactaatttttatatttttagcagacacagggttttaccatgttggccaggctggtctcaaactcctgacctcaggtgatccgcccacctcggcctcccacagtgcatgagccaccacgcccagcccattcaacaacattttatagaatcccctaaaggtggaggtcatgtttgcatcagagggtggtacaaggggagggaggtacttagcctattcctcaccatcttcatctcccactgagatcacctcacatacaggtgcccttccactgtgcttagccagtgagggactaaagactcccccacagagtataaattgccatgtctatttcagagtgacagctattaatattattattgttatgactctgaaagcccactcatctttgagtctctggcaagaggtgaaagacaggtgttgggaggtggctcctggagcgtctgtagacagcatttgcctaaataatggaatccacgtgtaataatcatgcttgagataaagagcttccccatccctcatgtccacttgcttttggagaaactacataagcaacattcccaagcagatgaggaggcatgaagcaagagaccttgatagtccagaagccgcatgagaaacgtcagctaaatgtagccaccctcttgctactacctacacaatcctctccagtgcaattggaaatcctgaatctcagcaaagatcaggcatgctaaactcaaccctggagacctgccttgcttttccctcaggccacccaggtaccatgtgactttcttatgagatgatcaaaacagtactttgtaaaggaacacttctattcaccaactcactcagcaaaatacttatggcaccccctgtgtatgccaggcatagtattaaagaccagggagaacaagaagagtaaatctagtcccacactctaggagcttaacgagcagcaattttgccctccccccagcaaataattgtctggcccataacgtcacgttcaaagactgagaaaccctgctaaaagaagacacagattttaaagaaatgataatgtgaaagaattaattgtagaagtgtactgtaatcccagcactttgggaggccgaggtaagcagatcatttgagctcaggagttcgagaccaggcttgggcaacatggtgaaacaccgtctctactaaaaatacaaaaaaaaaaaaaaaaaaaaaaaatagccaggcatgcaggcatggtggtacacacctgtggccccagctactcaggagcctgaggtgggaggatctcttgagcctggtagggcagagcttgcagtgagctgagattgcaccgctgctctccagcctgggtaacacagtgaggccctgtctcaaaaaaaaaaaaaaaagaagaagaagaagaagtgtatacagggtccaaccatagcaaaatcatgaggaggatcaccccaaaatacaagcatagcttctaccttaaaaacagaaatgaaaacccttatgtgacctcgtgtccctctgtagataattctccatttctctctgttcccttttatagcaaaaatgatctagagagttggctataaccaccctgcctacttctgtgctattctttcctctacgaactctggtcaggtgtggccacgacggtgctactgaaaggtatcctgcaacctctgtgttgtcaaatccacaggacaattctcattccttgtcctaccagcatcagacataatggagaattcctttcctggacttgccttcctgagcttcccactgccctggttttcttgctaccctactggttgctccctgtcagcctccttgatggtttgtcatcaccttcccaacctctcaacattgtagagcccaggaattggcaaactacagcctgtgagccaaatccagtccaccacccagtttttgtacatagagtttcattataacccagccatgcccattcattgatgcattatctagagctccttttgtgctaaaacggcagagttgagtagttgcaacagatcctatggcctgcaaagcctaaaacattttctactggccatttgtagaaaagtatgacctaagttatcagttaatcatatttccttaaactgactccattttaaatgaattttttattacgaaaattaccaaatataaaagagtggagcattctgtgaccttaaatactatctaaatgccgacagctgcacccacaacccaggctctctcctgagctccgtgttcacagatctagccaacctgtttgatatctgcttccacttgaatgtgaaatgatttgctgacatggccagagcagagctagagatatctccctcttctctgcgtcttccccatctcaacaaatgtcaactccatccagcacgttaactataccatattaaaactctaactaaaaataaagctaacatatgacccagcaatcctactgctaggcacatatccaaaagaaaggaaatcagtatatcaaagagatatctgcactcctatgtttattgcagcactattcacaatagccaaaatttggaaacaacctaagtgtctaccaacagatgaataaagaaaatgtggtatatatacacaatggagtactaatcagccataaaaagaataagatcctgtcatttggaacaacatggatagaactggaagtcatgacgttaagtggaaaaagccagacacagatagacaaacttcacatgttctcacccatctgtgggagctaaaaatgaaaacagttgaacccacagacagagagagtagtgcaatggttaccagaggctggaaagggtattgggggtgtgagggcagggaatagggatggttaatgggttcaaaaaatagaaagaacgaataagatatggtatttgaatgcacaagagagtgactgtagttaataacaacttaattgtatatttttaagtaagtaaaagagtataattggattgtttgtcacacaaaggacaaatgcttgaggtgatggatatcacatttaccctgatatgattatagcacatttgcatgcctctgtcaaaatatcccatatacctaacaaatatatacacctactatgtatgcacaataattaacaattttaaaaatttaagaaagaaatctaggactttgcccagtggggcaacctgggtgaagcatatactgaaattctctgtactaattttgcaacttttctacaactctaaaattatcctcaaattttaaagttgattaaataaaagccctaagaatcattctttctctctcattcttttctttctgttactccgcacatcaaatccatcagcaagtacagagcagtccactttccaagcacatccccaaactggtcagtttcaccacctccaccagtacctcctcacccaagtaaccatcctgtcctgtctccacctggattattgtaatatcctcctaactggcctccctggtgccccctatcccctcctcactccagaactcctactatccatgcagcatccagagtagtattttttaaagacataaataaagttaggtcaatcctttgttcagacccctccagtggttttccatcacagttgaaataaaacccaaactgctcttttaaaaagtttaattgtgtttaattgaacaaagaatgattcaagaattgtacagatctcgaaccagaacaggtgtgaagaggctccatttctaccacaaagaaaatttatggacagagaaggaaagtggcagacagaaaatggaagcgaggtgcagaaacagctggatccattacagcttggcatttgccctacttgagcccagtttgaacagttggtcccccttgattggctgaaactcggttgtttggacaacagtgggttacagtctgtttacacatccagttaggttgcagttcactacttatggagaaacctttaaagtatgtaaagaggcagcttttcgctaaacttaataattcccccttttgatcaacctctcagttgagagactgaccaaaactttaggcactggcatcactctgtcactatttggtttcaaatcccactaggaaatagcagtgggttttataaggtgggaacaagggcttcaggttattttttataagggttagagtagaaggaaccttcttgacctggtatctcctgttttcaggagaaaaacaaaaccaggtctattttaagatctatttgtttttaaagtcttttcatggccaagtcccatgagagctgccctctctctacctctcagaacctgtttcctcccacttcctatctgatcactctcctgcagccatcctagtcttcttactattccccagacatggcaagcccaccctcccctacccacccagcgtctagacacttgcagtcacctgctgcctatactccacacggctcacttcctcacctcctcagagagacctttcctgctcagcctctcttaaatactccacctttatccatccacagcactctctgtcttacctctccctgctttatttccctgtctagtacttaacactacctaaaattaacttatatgcttcttcattctgtttatcatcttgcttctctgaaaggtaaacttcctgatggtagagatcatgtccatcttgtttatggctgcaacctgtgccctgaacatgcctgacacatggtagatactaatatatctgttgaatatcatgcatgttgaatgaccctacccagaagaagtcaaagaaagtttcccgaggagatgactgttgagctggggactaaacaatgatgaaacaggcatgtgttaatttctttggctgcatagcaaccactactgccatcaatgccctcggggaatgctcactcttcctgtccgccatcttgatgagtctattaaatgcacttgcttgatcgagagctgagatgcaacatgcaagctgtgtccaacaggctttttaattttgagtagcatgccctcagagtcctgcctagtcccctcaacctctcaagtttgtgagttccccctcttttccttttcaactttagctagccagagaatgtgtctggtgcttacaagtgaagaactgtttctgacattgccagttaggtggggaggtgcattctagacagaggtaacaacttgcaccaaggcattgaagcatgaagcgatgggaaacaatggggcatgaaaatcaaatgttccttcaaggtgcaaacatattaccctaaaactccatggttccctagggactcaattcaaaagttacagggccatttttaggacatctctttgctataggaaaacaggacattttctgcaagatcaatgcttgaccaacatcagattcaatttttgcatccttcaaatcatatcaggctggaaaattaaaagtttcctctcatttttatcataattactataacaaccactaccatcttgtgtttgtccagtaatttcagcttttcaaagaaatttcaaatccattaacttagtctctaccaaggcctccgagttcgaggcattaaaggctccccaagtggaattaccaacgtgttataaacgaaagaatctgagtcaccaaaacagcccagcctctgtctgacctccgaccctcctcatctgacactacagcttttcccaaggcagctgcaggtgagatattcattcaaaccagcaggaagagaaatgctgaatctgcacaatcagaaccttctgctgacttagcaccatgtctacagagatgctgctcttgtccttcgtcctgagaaggagacacagtgtgcctgaaggagcccatctcagacaccctgcccctggcagcagccaccagggaagccagtacaatagtggtctcagtaagggaggacctaggactgcgcaaaaaaatcaagcagtgtaacccaaaaatccagataccagacagatccaagaatgtggctagtgccatttccatttgctcaaaattagcatcaaagttaggaagagtcagggttaaaatacaaacaccccatgctccaaccaaagcgatctgcatatggctgtccatacgcaccatgtacttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgaaattctatacatccactgagtccagtccgttttccccccaaccatcactcactctgacctggttcattctccaggagcctcagctgatttttctctagcttgatcacccttcttggtttcatgttcagttcaccattgcctttaatgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcatatttctaagtgaaagaagccaatctgaaaaggttacatactgtatgattccaactatatgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccatgtaggcctatcagttgtaacaattaatattgttacaagttggtactattctggtggggtatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctacgaaggggatatgctcctgcccaggtggagtttagcagggaatctggacagtgatgaagtcatttcaaatatgataaacccatcaggtatacacaaggagaaaagctaattttcatttttataggtattttataaacatttttctaaacactctactatagttagggtgattttacatatttctgccttgtttcttgtgctagaacataagatcctggccttgagtcagaggacaagtcaaaataaattttgtagccagagctaagttcagtatactgactctaagtcctataattgagactccaataccaaacaatctttgtttgggctggttagaattttccactcttacaaatgaacactcacctcatctagacctgccacttggacaactgagacggaaagatctccttaatgcagcatgtcctggaattcaagatattcattcaacaaacactgcctggtcacctacttcatgtcaaaccccgtgctgaatgctggaggggcatcggggtcttcgcaagtgctgtttcctccaccctcctcccacgtattcacaaggctcccctcctttctgcattaaggtctctgtgcaaaagtcctcatgtcagagagggttcctgtgcattcattaatgctgtccaccccacagtccagttttcctctcgttccaggcacatggcaggagagccctttcctggccccttgaatcagttgtggcaatcaaatgtgagctgaagcccttaagagccagcgtatgactcaccacatccccctccccacctacaccacaacaaccagccatgctccatctgggcccacaagtgaggcgatatggcgcagaagtcgtagccaaccctcggtgggcacgttgcatgaacgagaaataagcctttattgttataagccattaagatacaggggctgtttgtgcagcagggcctcatccatcctagctgatccagctttcctgaaaccctatcttaaagggcatctcctgtcactttcagtctctttaccctgctttgcctgtggcacttaatgcaatctaacattatatatttaccgtgtttatattttgtccccatcccctggaatataagtttgataagggcagggacattgttcccccagcatcctcagtgccctgaactgtgtgcctgggtagaggaggctcagtacatgtttatggaatgactcactgaacacattaacacataagacactgttcctgtcctcactgaggacagctgggaagctaaatcaacaaataaattatcagaatgcaggagctacaaaagtataggaacggcacctaatcctgtgggggacagcagtccaaggtttctcagagggcatggcttctgagatgagttttgaaggatatgagacagacagaaatagcagcacagacaagtgccagaaaatgtgaaagaggcacatttagagcaatgtgggtttttgttatattttagcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaactgcaaaatgaggagagaactgagttgaagctcaaaaggtcagcaggggtcagaaatcagggatttgtgcagccaggagtttacattttatctgaaggcaatgcagtgcacatggtgagtttgcaggaagaagttttattaccatcccccatcacagaaaatgaatatccttgttggtcttttcatcagcaccagtaatcaacatctgatgggccaggagacccatgggactggtactcaggaagcagtgtgtccctcagcaagtccctgagcctctctgagcctcatatttcacatctgtatgatggttcaagttaaatagtggacatcccttctacagtccctgccaattctcctggcagataatgtgactgcaataccatccatgattataatgtttggtataacgatttaatgtactatcttttccactgaaagagctctgtattagtctgttctcacactgataataaagacatatcggagactggtaacttataagggaaagaggtttaatggactcacagttccacatggctggggaggcctcacaatcatggcagaaggcaaatgagaagcaaggtcacatcttacatggcaagagagcatgtgcaggggaactcccatttataaaaccatcagatcttgtgagacttattcactatcacgaaaacagcacgggaaagacctgcccccatgattcaattacctcccactgaatccctcccaggacacatgaggattatggaagctacaattcaaggtgagatttaggtggggacacagccaaaccatatcaagttcaaaggctcaaaggacttcaaaagaaggggcaagaataaataatcgcacagaaatccactttaagtggtaggagggaccctggacgatgaaaagggtgatctagcccagggtccaggaaaactgtcaggcttcctgcccatctgcccactctgcacctgcacgcatacctgacttctttctccctagaagagctcctgtcccccacagtgattttcaactctcttgctatgcatgaggtcagccatttcatggctccacccaaatcttctgatgcaaaagtggaatggactcatgccataatgctgggctgcctgatcatcgcatgtggtcagctgtgtagcagaatataaattttaaaaacccaaacgattaaactgtcacttcctattagacaaagcacattccaagatgcaactaatgagggaagagaaataaggaaagaaagtatgtttgacagaggcagtgtggctatagctttctccacttctgattgacgacaagatggtttctcctgcaagtaggcacagatttgctctttcaacccacgtatactgggcactgaggggaggaagatgaaaatggctacagcaagggtatagaagaggaataaattcacagtcatgtggggaggccattctgtctgtcttctggcataaaaaaagactgagtgcataggaggcagaaggcgattgcttcaagcctaagaaatggaaaaggcaccttggagaacttgacacttaaaacttaaaggacttaaaggcaaagcgggactaacaatgacatgtttcacacttgtatttcttcttacagttttcagggttttcatacaccttatttcattcgatcctaataagaaccctgagaggtagatttcaactgtgctttccaaaagtaaagatggaggtgggaggaagaactcagcgatggagctagaactatgggcacgtgaaagaaagaacaagttatctaattcacctgatgggtgcactgtgggagacagagcctggtggtgatggggggcagactgaggtgattcttggatgcctggctaagggtttagaatttaccctgaatataatgttgatatcaccaaagctttaagagtggagagtaacatgtccaatgcgccccttgagtaggagagcttcccgtataagcaggaaactcagaagactggaatcaaagctcaggtggaaggtgataaggaccaggtgccagggatggagacgaaccaagagttgggcagtggaagaatggaaaacaccagagggccaggtatagtgtcagagattgttttatgtcttacttagatgagacacaaaataatattaaaagtatgcaggataaaactctgattatctttcaatccttctaattagtcagtgaggaagtctcatcttggtgctaataggtcttcaacacctttctaacacttgctaattatttaaaggagacaataatatactgtattagtccattctcacactgctataaaaatactaccagagacgggtaatttatagaggaagaggtttaattgactcacagttctgcatggctggggaggcctcagaaaacttacaatcatggcagaagatgaaggggaagcaaataccttcttcacggggagacaggaaagagtgtgagcatgcaggaaagactaccatctataaaactatcagatctcatgagaattcactcactcactatcatgagaacagcatgggggaaacagcccccacgatcaatcacttcccttcttcaacacttggggattgcaattcgagatgagatttggatgaggacacagagccaaaccatatcatatgctaagtgagacttggcaggaacagtagtttgttatattttaatattactactgtaatctttatttttggtttttttactagtggcaagattttgtttgtttatttgattgttagtttgctgttatcttctgcttatcataagtgaaactggttttcattattggcagtgatataccattctcttttaaactatatttatttttatttatttatttatttattttttgagacaggatctcactctgtcaccaaggctggagtacagtggcccaatcacagcccactgcagcctcaacctcctgggctcaggtgatcctactacttcagcctctcgagcagctgggaccacaggcatgtgccaacacacccggctaattttcatattttttgtagagacaggattccaccatattgccgaggctagtcccagactcctgggctcaagagatccacccgtctcagcctcccaaagtgctaggattacaggcgtgagccactgtatctggcatcattttattttaagatgtaaagaaaagtattctggtggtgggagtagggggatatctatcctcaataagtcaagcatagtattaccatgtgacccagcagtttcactcttgggtataaatccaaaagaattgaaaacaggtgttcaaacaaaaacttgtacataaatgtttatagcagcaccattcacaatagctaacagatggaaacagcacaaatgcccatcaatggttgaatagataaattaaatatagtatatccatacaatggaatattattcagccatgaaaaggaataaagtactgattcatgctacgacatggatggaccttgaaaacattatgctaagtgaaagatgccagatgcaaaaggtcacataacagacgatcccatcccatctagaacgagtaaatccacagatacagaaagcagattaaaggtttccaggagctggaggggtggggaaatagatcgtaactgcttgatggttactggtctccttttggagtgatgatgttctggacctagatggaggtgctggtcacacaacattgtgaacgtactaaacgccactgaattgttcactttaaaatgtttagaatggcagattctatgttatgtgtattatatcacaataaaaaattagtcaaagtggccaaaatgttgtgaaggtgccatggaaggaaacaaaacttaagaaattcttctgatcaaaaaaacagaggttgtggagtcaggagacctgagttcagggcccagctctgttacctgcctaccagcagtgtcaccaaaaataagcttctgtgattccctgggcttcactttcctcctctctacaatgagggtggtggtcctcggatccctgcctgcaacactctgcctgcacatcagggagctcaatatacatccgtccctcatgttccttccaagcaaggaaggcttggacaacaggaataccattgacagagagaagaaatccagaataagcatgaatcaaagaggacaggcctgggcaggttcagtatgaggcacccatggccatgtcaaggagagaagcccaccaagcacctaggggaacaggtcaggaacccagggcaagaggttgaggctacaactgtagattgtggaggcatctgcaaagctccaactactaaggactatatctagagaagaggagctgatgggatgcttggagggctctcgcctgtacagaggtgtaggtcccccaagcatgcaaaaggcagatcatcatcaatgaggctggagtgactcctgacttccaacaagcagcggagtctgtcaaggagtggaccttagcccaatcccattttacagatgaggaaaggtaaggtccagaagggagagaggaaggaagaagatacactataaaggtattattttagatagataatatatattattttatagatagctaaatgatacacaaatatattattctttgtgagagagaatatgaaagctcaaattccatcccagatcgcctaactcaaagctccacatttttgcaatacaaactatcgttctcattatgtggaacccacccaaagaaggccagatattaaagctgtaagagcatttagcccaactttcttacttgcaggagaaactgaatttcagagtttgccgcaagtcaaggaatgcagttctggaagctagtaaaggaaaggaaacagactcttccccagagtctccagagggagcacagctttgctgacaccttcattttggtgcagggaacctgatttcagacttctgccctccagggctgtaagagggtaaaagtgcgtttccttcagccaccatgtttgtgatgataatttattacagcagctgtagtaaactaatacaatcctggacctagccccttctcctaactcactattttgtttgaacatctactaagtacctactctccctcaaaacaatgttctgagtgctggaagtatagaatgatgaagtcatcaatacaagcgggatatggtctccccaaaccaagagaacaggagcacacagcacaagtgggcgtggaccaagggcatgtgaactgtggatgggttgtagacttgagcaagttcgtttctagcttctaaattccaccccagcaagtaccccagacctggctttaggaaccacgatatggcagcatgaagtggggacctcatgacaacacattctaagtaggattttggtaacaagaaggatcaaagccccatctgcatctctcatgtcatctctgcattgttgatgattcatctttttcatacaactgcttggagggcatcagagactttcccacattcagcggagccagagattttggctgttttaatgaattcttctaaccggttgcaccgccccaaattgaccgtaaaagttaacagatttgtttaagaaacaaaacttgatctcaatatattgtggacaaatgctcaatcgaacagaaagctcactgttaatttgctcttcctccttctgtattctccagctatcctgaatttcttgtctcttctcccctccaggcacaaaaatgataaggaaactttgcttgggaagaatttcgcagaggcacgttcgtggagccaggttttggggtttcgggtttcaaagtgcataccaccccagggttctcaaacagaggcacacacagcccagcagaacacacgtgcagagcacaaatacagtagaacttcctagagcattgcttttacttgtgatatggtttggctgtgtccccacataaatctcatcttgaattgtagttcccatcatcctcacgtgttgtgggagggacctggtgggaggtaatttaatcatgagaatggttacccccatgctgttctcatgatagtgagtgagttctcacaagatctgatggtcttattaggggcttttcccccttttgctcacacttctccttgctgctgccatatgaagaagtacatgttggcttccccttctgccatgattgtaaatttccggaggcctcccagccacactgaactgtgagtcaattaaacctttttcctttataaattacccagtcttgggtacgtcttcattagcagtgtgagaacgaactaatacaacttaactatttgatgaagggaaaaatggacacacttatcttttaagtcattttaaattatttcgccttagtaccaacatagttacattatgaggtaggaaccaaaatctgcatgaatttttaagatcaaattcagagaaaaggccacaaagggcacagcctgatgtgcagagcgtgtgtttatcagacgctgtccctgtattggcttcctattgctgttctaacaaattaccaccaatttagtggctctaagcagcacagattctttctcttatggctccagaggtccaaagtctgaagtgggtcaagcagctggcagggtggcattccttccagaggccctagaggaggacctatctccttgccttctccagcttctggaggatgctggcattccttggattacagccccttcctccatcttcaaagtgcatcactccaatctctgcttctgttgccacatctgcttctctgactctcacctccctgcctccctttcataaggaatgattataaattggactcacctaggctaatccagaacagtctctccatttcaagatccttaatttaattatatttgcaaagtccctttagccatataaggttagtattcacaggttccaggaattagaatgtggatgtctttgggtggggaagagggggtggtggggacatgattctgcctaccacaccccctaggactatttgagtaaaaattcctgagaagcattgaacctagaagtcctagaagggttttaggaaggattctaagacagggactcagttcctcaaagcaggagcctagtgtccagaaagggagcccacatgagaagaacaaagtcagtgttagagcaggtggaggtctgggttctgagctgaggtgtcttgactccactgaggctcagttacagaagaggagtgaggagaagccttggaattaagctctaactacctcccaacctctctgtattcattttcccaggctgctgtaacaaaggatcacagtctttattacagcaaagatggtttaaacaacagaaatgtaatttgttcacagttctcaaagctagaagtctaagacaagggagctgcaggattgctcctctgaaaactgtctccttggcatacagatggccatcctctccctgtgtcttcacatggtcctccctttgtgtgtttatgttgtgtcttaatttcctgttcttataaggacaccagtcatgttgggttaaggcttacctatatgccctcattttaccataattactcttaaagactccagctccaaagtgtcacattcagagatactaggggttaggacccaatatatgacttttagggagatacaattcagtgcattctcaacaataaacaacatatcagagggttctcctaccctcggatgaaaccagagacgtgcttctttctcctgaagcccatttgaaaacctccatgaaccaggacagggatggaggatttcctatttcggaggagggaaggaagccacagactctacaagtaaactaagcacatgatcccacgaaggcacatccaaggctctcttttgaaagttgatctttaacaaagttaatttaggctgtggagtattttttggtgagttaaaagattatttttatgcttctgcaaatgagcacatcacaccccaaaaccagagactaaaacagccctcttcattcaaccccaatgaaaacaggaattgtttgggaatctcttgccctagaagacagggaacatgggagtggggagtgggcggtggcatggacagctggcttcagctcctgtgcttttcatgggagaaaggcaggcttatgatagacagctagaaaattaacccacaagagacaagccaaagcaccaggctcagaaggtggaaggttagaaggaagcacatttctgttttcatattttaggaaagagatcttcaaaatgctctcagccctacctccctttttcagggcatggttaatatatggcagaggagacagccatcctgtgtccttttctaaacagttccctgagaaaacttctgcatacacgttggcataaatgacacgtgagatctcgctgatatcctggctggtgtgcactggtgcagcagaactggttatttaaaggctgaaatgcttccgttttgcttgtgaatagccacatcttccaggaaccccaagtgccccctgccactcagcccctcccttgggaaccccctacctccccataaccagccactaaaggattaacacctcacataacaggtgctccagaattctacaaagtgagtgtctattctgattcagctgtgataatgctgtagtggttaaatattttgagtattcctcacagctgttaatatcaaacataaatctctcccacttttgtttaaaactcattttactgccccctgccacctgggcaatatccctttcctatcacaaggcagttcttgttacaaccttgtggggattcaatcagactggtgggaaaaattttggttatagagaatagccacaaaccttcttggaaggcctgaaggtttttgcaaaagtctgagaataagtttatggcttaaggcaacctaatccttaccttaagtaaatagcttgaagtgggtacaaaggaaggcagagcagtttatctaactagcttgtttactcacgtggtcttaagaccaatatttgatcattcttgagtgcatgatggctctctccggggtaggggcaaccaggttaattacccaccaatgtgtttactcacaacctttgtcaattaatatttactgaataaatgtgagtctcactggcaagtcgaggccgtggccactgactctgtacagaaccttccttggtgtctgtaagtggcacggacactcagctagactggcaaagcagaatatctgtgcgtcagggaactttattcatctgtcattgggtcagggtctgcgggacggaccccgcaaaacctcaccctgcctctgcttttttagagaaaggaacaaacaagggcttcccatccctaccgttccccacaaagcctgggacacgaacatgactccagcccaattggacgtgagtctctacctagactcctggcaaatcataacagtggggtcccacagaatgattttctgctgagaaattttacatattaaagcaatgattgaaacaacactgatacagagacaatgggtgagcaatgcctggtgatgaagaatgaataatcatagaactccccgccaggcttcaaaatatttattattttttagaaattcaaattactccactgtatgttatattggaagccatcattgtctgaggttttccatttacacaatgagaaatatcaaagcagttaaaatatgcaatacctagggaatataaaagcgatgcttaaattaaaatatattccatggcaggtgtcttaaaagagatgcaaattataacaatgagttaatatttttgtctagccaatcagaaaaatttctgtttcaagagccagccagagttaagtgacagagatactttaagacatagttattagaagtgtccagtgattcaatctttctgggaacaaattaacggaaccttaattggttctgtattgatagttttaaaattctttaatttcagtaatggattctattaaaagccaataatctgtgatgtagacatttcattacaaagatgttaaacaaggtattggttttcatggcaaaaaattggggaaaatctaaattatcaagtaaatcatgagatatccacagaatagaaaacatagaagataaaaatgtttacaagtaatctgaaagcctcatgataaaatgttaagcaaattaaaagctatctataaaattatatagtgtgtatttgtaaataaggtataggaaaacagactagagggaaataaaccaaaatgttaatagcagttgtctgtggatgctgagagtaaaggtgatttttattttctttatactgccctgattctcacaaaatcctctaaaatacatatgtatagattacttgtatattagctgtgatttttttcaacagttcttaaagttcttatatttttgatatatatatacatatatatatatatatgtatatatatatactgacatatttactgatgaacacaatgatgtcttggatttgctttaaaatgatccagcagtgggtccatgataaaaatatttctttcaatgctgctaaacaggagagagacagagacagagagagagagaagaggagaggggaggggaggggaggggagaaaggaggggaggggagaaaggaggggaggggagaaaggaggggaggggagaaaggaggggaggggagaggagaagagaagagaggagtggagaagggaggggagggaagagaaaaagaagagaggagaagagaagaggaaaaactagtatcaattaaccaaggcaaaaccaatagcaaatttgtttttaactaaagtgcaaatttgaccatgaaggtcttcacccaaggcctgccattttcaaaatcccattcatggaagccatgcacacaccctaacaccagaactacagcaagcctgcctttttccacagctccacagcttcttcacatcgttctgagtctactcacccaagtcagttaatactacatttcctcagtcctacagatatcttagcattaaaacaattcgccaggaaaatatgtctttttctttcacccctaggacagcagactagcaagacgatatggatttcaaatgccactcactcttcctgggcaggtattcctaatttgaagagacaagatagagcaggagacattcagccatttgtgacaacaaaacggaaatctgcaaaaagctcaatgtttgatggtaagaaatgccatccagaggagaatttggaagctttcaagaccactcaagactggcagccttgaggaacaggttaagaggagaggaaggcttagattgtgaactcaattctgctcctccatgagccagccttccctctacagctcatcttcagctgtgggggatgacaacctgtaggggcaggcacccaggacacaagcctcttccagaccagctctccaatttgaccccagatccctaccctcagacctgtggatgaagctgtccctcctctgcattcccatggtcccgtgaatacaatcatactgcacttgcattatgagtctctccagctagattctgaaacaaattgataacagatgcatccacaaagcattttggtccaaggacaaagccaagaaatgtatgaagaatgaacatacatttgacctgtgaacaacacactgcatgcgtctacctatacgcaaatttcttctccctctgccaacccctgaggcagcaagaccaacccctcctcttcctcctcctcctcagcctcctcaatgtaaagacaaggatgaagacctttatgatgacccacatccacttgaatagcaaacatattttcttccttacgattttccttatgatcttcttttctatggcttacttaagaatctactatataatacatatagcatagaaaatttgtattaattgactgtctatgttattggtaaggcttctgatcaacagtgggctatagtttatgggaatcaaaagttatacatggattttaaactgcatgggggttaatgcaactagcgcctgcattattcaaggatcaactgtgtttaataaaccaataaataaatcaaatccaaggaagtctatgaaagggtttcagagggtctgtgatcccctgaaattgcacataattttgactgcatgtttatgaacacgcactcctctggaagggtccgtagccttcattagattttaaagtggtccccaactccccccaaaatcaccccaaattatcttaaattctttgagtgagtttgtgagccaagcttcaaggtgtcagtgatttttggaaatcacaacttacattttagagtgagtttatttttgttttggcaaaagagtcactgttagggaccaatggaaacaattaacctttttcaagtcagggattgtagttttcaagtcagggattgtagtttaagagaagatcctttccatatgccgacttcagcaaaaaaaaatcacaaacagaaagaaatttccattccaattaatattttccctcctgaaatgggtaacatagccacctccatggaagggaacctgagttcgaagatctacgatgcattaatggagcaaatattctttctctgaatgctctattgtattatttaggttttttcgctctgtacatcaacatctatttcaaagtttaaaaaatggagacaatatatcaattgccatcccatggaaagttccaaaatttgaacagaaagtgaaagcatttggaaagcaatttcaggttcgtttttctttggggggatgtgggggaataggagaagtggataaacaacagaatagtatctagagtattttctgccataagcagatgttccaaatgcaggagaatacaactgactaaaaagaataatttgtcaactgaaaaaccagagaggagtctggctggctctttagaatacaaacatattactacagtaagatgtgcaaaacaagctgaatatactttattaagtaataatgattaacctgatacaagtgcaaaaacaccccatttcgagatcattggcaattattctaaacattgtcttctgtagatgagcttcttagccaaaaacattttcactagtaaatatgaggccggctgacctacttatgtttttatttatatatgtgtgtgtgagttgatatatacataggttgtctgcttttcaaatatcttctaccttcaggataatgtaaagtcttttgggaacttgaggtgatgatgcagggattataaattcctcctccatgccaggcaaatttatactgaattactcacacacttggaaaaagtgaggatgttggttttcagccaaatgcttggcctaaagcaccaaggcttggagatctttttttaaaaatcaaggatttgagaggtacagagtgtttgaataagaaagagcctcagaggtgacccaacccaaccttgcaagcccaattttccacctcattcctgagggacagacagtcactgttagctcaatcatatcctgatatagccttcctattccatgaatcctcacagtcttctgttagagacctaattgccgaagcttattcctcatatcaagatgaaactttactccttatagtttcactcttggccaggtgccgtggctaacgcctgtagtccagcactttaggaggccaaagcgggtggatcacctgaggtcaggagttcaagaccagcctggccaacatggtaaaaccccatctctactaaaaatacaaagttagctgatggtggtggcaggtgcctgtaatcccagctactcaggaggctgaggcaggagcatcacttgaacccaggcggcagaggttgcagtaaaccaagatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatatcccctctgagatttcccttctccaggctaaacatccctaaatacttcttctgaaactcttaatatatttcatttagagtctacgcaatcctaaaggccctttttctgcatgcattgcaatttttcaacgtccatctttagatatcactcctcggaactaagtgcaatgctacatataatggtgttagtgttgctggagacatcaccagttgtaccactgaagcatcaccccacacccttgctaacagaagcaattttgctcagtggcaattacccattctcagagaggaatcctggatctctatcattgttgtttgagcagtgggaatgtgacccagttctggccactgacatgtaagaggaagtctactccaatgaaaggatagaggccctagaagaaggcttatttttctctccctttttttccagttttgaatgctaggaggtgaaggtgtgatggctggaacagaagcagccatattgtgactcagataaaccagcagctgaggaaggcaaagtagaagaatgggaaggatctgagtcctcaatgtgacattaagtcactaagctagatctgaggctccttactaagcaaaaaactgaatgtctttaatggtttaagacactgttggtcaaagactctgttacttgcacctgaaagcactccaaacaacagaagaggtataatggagctatcacctcccttgatttaaacattatatttctataaatgtggcctccactttttataaggccacaacgtatgtggcctccacatatatttctagatatgtggcctccacatatccccacttaggatctgctgagcttctggtcaatacaaaataaacaaacaaacaaataaaaagtctgtatttgagcaccatgatctcaaatactcacagaaaccatatcattaacataaatgtatgaatcaccctagatatgggataacagagtggggacagctgtagtgaatttgaaaatgcatgctgtctaaagacattaaaattcaagcatttaaaaatgctgtactggtgaaacaaaatgcatctatgagccagattcagcgtgcagtacaccggttcatgacccttgcaaaaaccattcccaagtgagttggatgtgatagttggaacagaggcagccacattatgactaagtgagttgcaaagtctcacatccccctttctgcaatagtgaaaattcttcttcaaactattgagagaggttggtcaaaaggcaccaacttccacttgtaaggtaaataggttctagagacctaatgtatagcatggtgactggtgatagcatggtgacaatacaaaaatatattgtatacaggcaatttgctaagataccacatcttaagtaatctcatcacacaataaatgtaaccatgtgaggtaatggatatgttaattagtttgatggtgacaatcatctcacatttacttgtatatcagaatatcatttggggctggggacggtggcttatgcctgtaataccagcactttgggaggccaagggaagaggattgcttgagtccaggagttcaagaccagcctgggcaacatggtgagacccccgtctctaccaaaaatttaaaaattagccggatatcatggcacacgcctgtgttcctagctacttgggaggctgagatgagaggatcacctaagcccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagtgactccatcacttcaatctgaagttttgaattttaattccatcatccaacatcttaatccttttagtcaagacaaccaaaatatgaacatcaaaatctgttatttgtcttgcatctgagccccttccctaaatcaaatgtattcgtagtcattaacttgaaagggtaataaaataagagcaaaagaataagaacccaaagccctaggttctagttacagctttgaacaatgcacaaattactgcaactcccagatcctttatttcctcatctgaaaatagagattctttaaacaaataccgttggagctgccaggtttcccaggctatcactgagttattaatccttggcagagataaaatgagaaactatatatgtccacactctaaatccctaagcctcgtgcaaacatatggtccagttggtggagtcatttagtgcaaaggtcaatgagatagtcttctcctgcgatcactttcatgctggccacatttagcttccgtttgccaggataaagctctcagcaagtcctacaaaggcaaaggaagcttctgattgtctcagttaagaaaatacaaatcatttcatgttagaccctccacttctgacagttctgtgggattcactcccagtttctttcagagcataccctcatgtaaccacatcatccttaatcactctttctggttattaaaaagtacatgtacactggagaaaaataaaaactaaaaaatgcagacacaataacaatagcattcctgtaataagcatttattataaggtaggcactgagacatggactaatatccatgatgtcatttaaatctcacaactctacaaagtggatgctattattgttcccattttagagatgaagacattgaggctcaagatattaagaacttccccatgatcacccagccagtaagaggtggaatccctgaatttaaattcaggcaatctaactcaaagtacaatatattaaccacttgataatgacattctttaaaagattaaagcagccatgagtctaccaccccaaagataactgctattcatattttggtatgtttgttgccagtctttccttgatgaggcacaaaattttcagagctggaagagatcttagtgataattttgtcccaaatcctcattttgcaggagaaccagaggttcagacaggtgaagggccttttctaaggtcacacaggtatttttgaaaattgaatttcattcttcagactctttgtccaaggttttcttggatcttccaactcaagttgattcatcatggctgcctggagtactgtgttgagaaggccttaaggccagtgggctcaacagggccaggtgttataggagattaatgatggcagcagtgaacatggcatccatggttgcatacatgccatagatctgccgtcttatccaggagcagcccctggaagagctacttccctcacctacatcataggcctcacagccaagtgccttcaggatactgtgtatgtaacataaatgagtgaagtgaagtgaagtgaagtgactttggggaatttaagaaaggaggggcacctgtcctgtcccaggatggcagtgggagggcagggatcgtggcaggtggggttgggggatgagattcatctccagccaactgttgccatagggggaatcggggccagtatggccaggccttctgactgtttcaaagcagcatgaagtttggattttcttttcaatgggatgtcttccaactttaaaatgttggcaaagaattagaagttgaaagatcaaggatgggggatgcaggacaaacaaaagacaccaattaataaccttataatgtctcatttatgtgatgacttatcagaggctaccaactctctattacaaaccagagattcagttcctgtttctcttctgcacagccctctttctctctctttccccactcactctgcctacagtagcattttccatctgaggctatgagaaagaagataaacaccgctgcaaacccaccagaccacagctcttcagggcccaaacgattgtcagcaacccctgagggctacttggagtgtgagtcacgctaccgggaggacgcctgttggtctctgatgacttaagtgaggaggtgttgatgatcgcatctgacatgcctcatggaaaagactaaagataggtctccccactctcccaggaactacctgatgcctctttagcaggagctgagtgggctccaccaacattccgatctgtgcgtctgcccttttcgagagctctcagtgtttaatgggaaggcccatcactcgcatccaaactctggagctgccaggttacaagagcaccaacttccacctcctgctgatgagctgttactcagcagttctctacaggcctttcgtatgtaaccccccaatttatgctaatcctcaggatggctggtaattatctgcccactagagagaagagaaaaattggcaaacacctatgaaatcagtcagcattgagggaacaaacactgcacgaatgccctgaaccatattgtgatatgttcatccggaagctccaacaagctggcatcggagccaatgactagattcattcaatcaacaaacatttaccgtgtaacaaacgcaaagggcaggacaagtgtgaggtactgaaaaggatgcccctatggagcacaaatgaatattattaatggtggaaaaagagagaaattgttaaaataattgtggtatgaactgaacactctgcagccattgaaaatcaagtttaagaagtctatgtagtgataaaggaaaattccaagaatacataatcaagtttaaaaaaatatataaaagcaggttgtgaaataaaacggggtcaaaatccgagtgaacacactcagtaaccttccttttctgctcctaagacatagaatttttaaagaaacctttagttatttttaaatttacatagtattgcttgcaaataagaaaagagaatcacagatcaaaaatagagagtaatccctaaaaataaatgaactgaaagacgggactctagggtttcaagtaggaatcaaagccacataatccatggaggataggtccaatatgagccatgagaacagaggtgtcaatgtccatccagggaaaaaggggaagaactggacctagaatcaggctgctagctgtggatggtgctggaacatctgcaccatccaccattagtcacagccaaaaagcaggaccctatctgtgtcaaggagccaaaatgaagtcacctacatgagatggactcctaagcctgtaccacaggccacgtagaatgggaagagagtacaaacctgagctgctgacatgggctctggcttaaaatacacaccctcacagatacagggcataagaaatcataaagttgccttgaaaataagttcacaaacaaaaattaaagaacatatgtgaacatccaactaactgattctacaaatgaaggacttcacaactgaagaaggaaagatgctagagcaatcagagaagaactttataatacatattttttaatctttgaagggacaggggagggagttacatgcacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgattgagaaattacacatatatatatagtacagtcatgtgctgcataaggaggtttaggtcaacaatggaccacaagtacacaatgctggtcccataagattatattctaagtttttgctgtaccttttctgtgcttagatatgtttagatacacaaatactcaccaatgtattacagttgcttacaatatttagtatagcattcatacagtagagtatgctgtagaggcttgtagcctaggagcaagagcctatagctcatagcctaggtgtgtaacagactataccacctaggtttgtgtaagtgcactctgtgatgttcacacgattaaatcacctaacgatccatttctcagaacgtgtcccaccatgaagcaacgcatgactatacatatgcatgtatattcagaaggagagaatagaaagaatgatggaaagaaagaatccaacagatagcggctgagattttctccagaattaaagaaaatcttgaatcctctaagaaagtccacagagggcaaagcacaataagaaaaaccatatatactataaaatcctgagcatgcaactaaatagataaaaggaaatacaccaaagtgtcagtaatgtttacccatggtgataggatttggagagagatttttatcttctttaaatttcaatgtatttcctaagtgctctacaatgaaaaggcattatttttatatgtctgcggaggagagaagcatttgtcatgtcaaatacacatatacagataaacagtttttttaaaaatctgccctcaaacgacttacactctggcagaagacatgaggcttgcataggaataacatagaaaacgaaacccaagtgataactggcatggatggatatagctaaaatctgagcctcgtcttttcctgcatggagcaattaggaatatggggagaagtgatggggggtgagagggttaaggacactgagcagaagtgtaaagatctagcccatattctgggcttaccagggactattactgcagctggagtgtatttcacttagacagggtcaaaatggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctcagcctcctgagtagctgggattacaggggcctgccaccacatccagctgatttttgtatttttgtagagatggggtttaagcatgttggccaggctggtcttgaactcctgacctcaggtgatccacccgccttggcctcccaaagtgctaggattacaggtgtgaaccacctcgctcagccttattttcacctctaatttagttatattgcaagactacccaatgatgcgagcaaaacattagcacctccattgtaaattaaattaacaccacaaaaatccaccacatttgcatgacatttcaattgttataaggctttgttattttcttcaatggtcaagtagacagacagaaggaaaatgtggcacatacacaccatggaatactatgcagccataaaaaaggatgagttcatgtcctttgtaggcacacggatgaagctggaaaccatcattctcagcaaactaacgcaaggacaaaaaaccaaacaccgcatgttctcactcataggtgggaattgaacaatgagaacacttggacacaggaaggggaacatcacacactggggcctgtcatggggtggggggaggggggatggatagcactaggagatatacctaatgtaaatgacgagttaatgggtgcagcacaccaacatggcacatgtatacatatgtaacaaacctgcacgttgtgcacatataccctagaacttaaagtaaaaataaaaataaaaataaaaaaagttaaaaaaatgtgtgtgtgtgtgttcattttaactgataaccaaattgactactattcttaccagcaggggcactatcatgttgccaatgtagaagtaaatataacacacgtgtgttctggatgactttaccaaatcaacatcattttaacaggaggcagaggccttgtcaatctaggaaggttgaggctgtagtcataataccatttgcaagcgaggcaaggcagagttttaaacaatgcaccgtgactgtttctttggagacaaataaactcaatgttcagctctaaatgaaacatgtggcagaagcacaagccatctatatatgttactaatggaaggaagggctgttcacctctcagacaatctcctttctaaatacatccccagtttctcaaaatacgaccttttaaaccaacttctcttggtatcacccaactcctctcaatatcaccgttccacatggggaccagacatataccccgatgttacctccactgagctctttgcttccctgccaccttgcctcatctccctacagttccaccagaatcacagagagtggccaatgtctccaagaccaactctgaaagtcccaacaacaatcaggagtatcgaatcccctcctccatttttgaaccaatggaccctttcattcttcttctctccaacccctcttaagtctctattctttatttctctggaaatgtcttttctcatcttcctcttgccctttcctgattccttttctcttcttactcttaagtgaggtcacattttggtccacatccccaaaacgcagtttcatcccaaaggagagaagaatgtttccacccatactccctggacttctcaaaactttctttctaatgcccccttcaagggaagaacagttgctggtctagttggtcacaacctgccattcactgggtcaagattcactagcaggcagggtcactgcctatcaagggggttcccttccatgaccctacactcttccggcttctctctgcctacgttcggatgaatgagtcacatgacagcctgagccacacacctatcgactgagacttagaagtaagagccaaagcctacccggaacctcccagtctcacaccaccttttccaattcagcttttcccagatttctccattgggttgtgccaaaccctcatggatccagaaatttcactttcagtatggttactgtttccagtctatcactcctttagaaaaactcaagaaggaagaagggatccgtggtaatatttaaatcccaaaatcatactccaaggcgtggctggaaactggctgttcttctccctcaatgccttctttagaagattggcccctcccatacaaaagccctctaggctgtgattcatcatagctctccatgctcagcccctcccacaaaatgaaactgatcccttgtccctcctgaagatggatgacatcattaaagtatgggcttgatttagtggaatggaagatcacaccttgggatcagaaattcagctacctagctacatcagccactatgtggtcttggcaaattcccttaactcccctatggctcagtcacttcatctgaaagttacagcatgctccaagaaaccctaagatgctctccagttctgaaattgtcagtggtggcagagcatggctagtccctactctcttcttcccagacaggagccccccaaaactgagaagtgactgggaaaatgctcagctacacacaggaattctgctagcctgcaaatcatttaaaatgaatgtttaataagacactgcatcaattgtgtgctacagctgaatgtgctgcagcccaggagacctgaaagaattaatacggttaccaaaggagctggtaggaatcgctgaaacagaagcaaaagctgatgtgatgaatataaaagtgctttgagagcatcaaaaggaaagcgctacagtgaatgtctgctcactccactagaatatctcctgccatctaaggaacactctccaagaaggtctcagggctagaggctatggcacacaagtacacttactctttcctcgccttctgaactcccaatcttttctcaggacttagaggacagtacacacacaactccaatctttcccttttttctcattcctcactttacttcttcattccagccttcttccttccctccacttctgtgtaattcccaaaccaggctgtcataacatcgccttcaaatcttcaaatctctctcccttcttctccaaaccaaagctcccaggctgtccacaaaaaagaccctccctctcattcagagccaactgatttttgtacactctttcttgcattttgagactctccaactttagtaccaagacccatctttgttcaggagccaactccttcatctgagggccttggagccccagacaaagaacacgtaaggaaaatgccaggccctccatgctctgggtttggagttaattctttccactcccacccactccccttgaggaacgggtctctcctccgctcctctggcccagggcttctcaaactccccacctctgttcctctaactgcagagtcagaggaagcatgacattttttctgcccttttgtgctttacctaaaaactttgcattttcttccagaacctacccacatttaataatttttagaaatagttttagtcacttaccataagaggaaaaaatggacattttcccacaaaacaatcaggtaaaactggcattgtgaaaataggaagcatatgtctccagtgctcctgggcccacctctgtgccccatggtactcgtaaatctccaaacatgccaccaccgccaccaccaccaccccacagcctacttctcagttttctgagcgcttcctggcacacacacaccaaagtgctcctgtgtacaccattttcagaaacaaggcaaaaggcatttccattcatttctgggttggagaggcaagacctggttctcaccagggccagtggccacgaccctcccacccccacccccacttcacatcaagacagattctaggggcgtccgaagacctgcagcagctgccatgcagctggtggcttcccaggtcctggcagggcatcagtttccggccttaccttgtcagccatgatcatagatgcgcccccatgaatgcccaagatggggacgaaggtgtgggaggagataaaatccagcatctgggctacggcctcctggtccgtgtcgtccccaaacacgaggccgtggatgcgtgccccggacatgaggtcgcacacgtgcgtgatgaggctcttggggtcggtgcggttcatcagcagagctaccacgttcacgtccaggggcagccccgccgcctgctcggggccccacagtgttcgaagttcgcgctctgtcacgtcgtggctgtgacccagcatcaccgcaatatttagcgcggggggacccttctccgccgccgcgctcggcgccggaccgcgccagaccagaagggccggcagcaccagcagggtccaatagcccactctgcccatagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggct
